US010844384B2

(12) United States Patent
Fitzgerald et al.

(10) Patent No.: US 10,844,384 B2
(45) Date of Patent: Nov. 24, 2020

(54) GLUCOKINASE (GCK) IRNA COMPOSITIONS AND METHODS OF USE THEREOF

(71) Applicant: Alnylam Pharmaceuticals, Inc., Cambridge, MA (US)

(72) Inventors: Kevin Fitzgerald, Brookline, MA (US); David Erbe, Arlington, MA (US); Gregory Hinkle, Plymouth, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/849,776

(22) Filed: Dec. 21, 2017

(65) Prior Publication Data
US 2018/0195073 A1   Jul. 12, 2018

Related U.S. Application Data

(63) Continuation of application No. PCT/US2016/038616, filed on Jun. 22, 2016.

(60) Provisional application No. 62/260,876, filed on Nov. 30, 2015, provisional application No. 62/200,207, filed on Aug. 3, 2015, provisional application No. 62/183,413, filed on Jun. 23, 2015.

(51) Int. Cl.
   *C07H 21/04*      (2006.01)
   *C12N 15/113*     (2010.01)
   *A61K 31/713*     (2006.01)
   *A61K 45/06*      (2006.01)

(52) U.S. Cl.
   CPC ........ *C12N 15/1137* (2013.01); *A61K 31/713* (2013.01); *A61K 45/06* (2013.01); *C12Y 207/01002* (2013.01); *C12N 2310/14* (2013.01); *C12N 2310/315* (2013.01); *C12N 2310/321* (2013.01); *C12N 2310/322* (2013.01); *C12N 2310/351* (2013.01); *C12N 2310/3521* (2013.01); *C12N 2310/3533* (2013.01)

(58) Field of Classification Search
   None
   See application file for complete search history.

(56) References Cited

U.S. PATENT DOCUMENTS

| 7,691,997 B2 * | 4/2010 | Khvorova | ............ A61K 31/713 536/24.5 |
| 2015/0315594 A1 * | 11/2015 | Prakash | ................ C07H 19/20 536/24.5 |

OTHER PUBLICATIONS

Allerson, Charles R., et al. "Fully 2'-modified oligonucleotide duplexes with improved in vitro potency and stability compared to unmodified small interfering RNA." Journal of medicinal chemistry 48.4 (2005): 901-904.*
Reynolds et al., "Rational siRNA design for RNA interference," Nature Biotechnology, vol. 22, pp. 326-330, 2004.
Goldsworthy et al., "Role of the Transcription Factor Sox4 in Insulin Secretion and Impaired Glucose Tolerance", *Diabetes* 57:2234-2244, 2008.
Grabauskas et al., "Essential Elements for Glucosensing by Gastric Vagal Afferents: Immunocytochemistry and Electrophysiology Studies in the Rat", *Endocrinology* 154: 296-307, 2013.
Bain et al., "An Adenovirus Vector for Efficient RNA Interference-Mediated Suppression of Target Genes in Insulinoma Cells and Pancreatic Islets of Langerhans", *Diabetes* 53:2190-2194, 2004.
Levin et al., "Ventromedial Hypothalamic Glucokinase Is an Important Mediator of the Counterregulatory Response to Insulin-Induced Hypoglycemia", *Diabetes* 57:1371-1379, 2008.
Kang et al., "Glucokinase Is a Critical Regulator of Ventromedial Hypothalamic Neuronal Glucosensing", *Diabetes* 55:412-420, 2006.
International Search Report and Written Opinion from PCT/US2016/038616 dated Oct. 5, 2016.

* cited by examiner

*Primary Examiner* — Kimberly Chong
(74) *Attorney, Agent, or Firm* — McCarter & English, LLP; Maria Laccotripe Zacharakis; Deborah L. Nagle

(57) ABSTRACT

The invention relates to double stranded ribonucleic acid (dsRNA) compositions targeting a glucokinase (GCK) gene, as well as methods of inhibiting expression of a glucokinase (GCK) gene, and methods of treating subjects having a glycogen storage disease (GSD), e.g., type Ia GSD.

38 Claims, No Drawings
Specification includes a Sequence Listing.

GLUCOKINASE (GCK) IRNA COMPOSITIONS AND METHODS OF USE THEREOF

RELATED APPLICATIONS

This application is a 35 § U.S.C. 111(a) continuation application which claims the benefit of priority to PCT/US2016/038616, filed on Jun. 22, 2016, which claims the benefit of priority of U.S. Provisional Patent Application No. 62/183,413, filed on Jun. 23, 2015, U.S. Provisional Patent Application No. 62/200,207, filed on Aug. 3, 2015, and U.S. Provisional Patent Application No. 62/260,876, filed on Nov. 30, 2015. The entire contents of each of the foregoing applications are hereby incorporated herein by reference.

SEQUENCE LISTING

The instant application contains a Sequence Listing which has been submitted electronically in ASCII format and is hereby incorporated by reference in its entirety. Said ASCII copy, created on Dec. 13, 2017, is named 121301-03704_SL.txt and is 523,732 bytes in size.

BACKGROUND OF THE INVENTION

Hypoglycemia is a biochemical symptom indicating the presence of an underlying disease or disorder. Since glucose is the fundamental energy currency of the cell, diseases and disorders that affect its availability or use can cause hypoglycemia.

The body normally defends against hypoglycemia by decreasing insulin secretion and increasing glucagon, epinephrine, growth hormone, and cortisol secretion. These hormonal changes combine to increase hepatic glucose production, increase alternative fuel availability, and decrease glucose use. The increase in hepatic glucose production is initially caused by the breakdown of liver glycogen stores resulting from lower insulin levels and increased glucagon levels. When glycogen stores become depleted and protein breakdown increases because of increased cortisol levels, hepatic gluconeogenesis replaces glycogenolysis as the primary source of glucose production. Decreased use of peripheral glucose occurs initially because of a fall in insulin levels and later because of increases in epinephrine, cortisol, and growth hormone levels.

All of these events increase lipolysis and plasma free fatty acid levels, which are then available as an alternative fuel source and act to competitively inhibit glucose use. Plasma free fatty acids also stimulate glucose production. Hypoglycemia occurs when one or more of these counterregulatory mechanisms fail because of, for example, the overuse of glucose (as in hyperinsulinism) or the underproduction of glucose (as in a glycogen-storage diseases).

GSD is an inherited genetic disorder due to an absence or deficiency of one of the enzymes responsible for making or breaking down glycogen in the body. This enzyme deficiency causes either abnormal tissue concentrations of glycogen or incorrectly or abnormally formed glycogen and patients with glycogen storage diseases (GSD) may also have low blood glucose levels. GSD occurs in about one of 50,000 to 100,000 births. Some patients might die before diagnosis, while severe infantile forms and some milder forms might go unrecognized Symptoms of GSD vary based on the enzyme that is missing and usually result from the buildup of glycogen or from the inability to produce glucose when needed. Because GSD occurs mainly in muscles and the liver, those areas show the most symptoms, such as, poor growth, muscle cramps, low blood sugar, enlarged liver, swollen belly, and abnormal blood chemistry.

Current treatments for glycogen storage diseases have been very limited and mainly focused on correcting hypoglycemia and other metabolic disturbances through dietary control, such as, by using a modified form of cornstarch, or a high-protein diet.

Accordingly, there is a need in the art for alternative treatments for subjects having a glycogen storage disease (GSD), e.g., type Ia GSD, which are independent of the underlying molecular defects.

SUMMARY OF THE INVENTION

The present invention provides iRNA compositions which effect the RNA-induced silencing complex (RISC)-mediated cleavage of RNA transcripts of a glucokinase (GCK) gene. The GCK gene may be within a cell, e.g., a cell within a subject, such as a human. The present invention also provides methods of using the iRNA compositions of the invention for inhibiting the expression of a GCK gene and/or for treating a subject who would benefit from inhibiting or reducing the expression of a GCK gene, e.g., a subject suffering or prone to suffering from a glycogen storage disease (GSD), or one or more signs or symptoms of GSD, such as hypoglycemia, lactic acidosis, hyperuricemia, hyperlipidemia, hepatomegaly, kidney disease as a result if glycogen accumulation, hunger, jitteriness, lethargy, apnea, seizures, diaphoresis, confusion, headaches, dizziness, unusual mood or behavior changes, loss of consciousness, coma, muscle cramps, bleeding diathesis, short stature, osteoporosis, delayed puberty, gout, renal disease, systemic hypertension, pulmonary hypertension, hepatic adenomas, pancreatitis, anemia, vitamin D deficiency, polycystic ovaries, irregular menstrual cycles, menorrhagia, and/or eruptive xanthomata.

GCK in the liver of a subject is the rate limiting enzyme for both glucose uptake and glycogen synthesis. Furthermore, the liver is a major site for regulation of whole body glucose metabolism. Therefore, by inhibiting expression of a glucokinase gene, e.g., a glucokinase gene in the liver of a subject, with a double stranded RNAi agent of the invention, e.g., an RNAi agent that contains and/or is coupled to a ligand, e.g., GalNAc3, that directs the RNAi agent to a site of interest, e.g., the liver, hepatic glucose uptake and storage will decrease, thus, inhibiting hypoglycemia, e.g., fasting hypoglycemia, in subjects suffering or prone to suffering from a glycogen storage disease (GSD), e.g., type Ia GSD, independent of the underlying cause. Furthermore, by inhibiting expression of a glucokinase gene, e.g., a glucokinase gene in the liver of a subject, with a double stranded RNAi agent of the invention, insulin resistance in the liver is selectively induced without altering insulin clearance in order to maintain safe glucose levels in subjects suffering or prone to suffering from a glycogen storage disease (GSD), e.g., type Ia GSD. In addition, by inhibiting expression of a glucokinase gene, e.g., a glucokinase gene in the liver of a subject having a glycogen storage disease (GSD), e.g., type Ia GSD, with a double stranded RNAi agent of the invention, hepatic glucose uptake and storage will decrease, thus, inhibiting hypoglycemia, e.g., fasting hypoglycemia, inhibit hepatic glycogen storage to inhibit hepatomegaly, reduce lipid abnormalities, lactic acidosis and/or hyperuricemia.

Accordingly, in one aspect, the present invention provides double stranded ribonucleic acids (RNAi) agents for inhibiting expression of a glucokinase (GCK) gene. The double stranded RNAi agents comprise a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:15.

In another aspect, the invention provides double stranded ribonucleic acids (RNAi) agents for inhibiting expression of glucokinase (GCK), wherein the double stranded RNAi agents comprises a sense strand and an antisense strand, the antisense strand comprising a region of complementarity which comprises at least 15 contiguous nucleotides differing no more than 3 nucleotides from any one of the antisense sequences listed in any one of Tables 2, 3, 6, and 7.

In certain embodiments, the double stranded RNAi agent comprises at least one modified nucleotide. In one embodiment, the modified nucleotide comprises a 2'-O-methyl modified nucleotide. In another embodiment, the modified nucleotide comprises a 2'-fluoro modified nucleotide. In one embodiment, the modified nucleotide comprises a 3'-terminal deoxy-thymine (dT) nucleotide. In another embodiment, the modified nucleotide comprises a short sequence of deoxy-thymine (dT) nucleotides.

In certain embodiments, the dsRNA comprises no more than 4 (i.e., 4, 3, 2, 1, or 0) unmodified nucleotides in the sense strand. In certain embodiments, the dsRNA comprises no more than 4 (i.e., 4, 3, 2, 1, or 0) unmodified nucleotides in the antisense strand. In certain embodiments, the double stranded RNAi agent comprises no more than 4 (i.e., 4, 3, 2, 1, or 0) unmodified nucleotides in both the sense strand and the antisense strand. In certain embodiments, the double stranded RNAi agent comprises all modified nucleotides in the sense strand. In certain embodiments, the dsRNA comprises all modified nucleotides in the antisense strand. In certain embodiments, the double stranded RNAi agent comprises all modified nucleotides in both the sense strand and the antisense strand.

In one aspect, the present invention provides double stranded ribonucleic acid (RNAi) agents for inhibiting expression of glucokinase (GCK), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:15, wherein substantially all of the nucleotides of the sense strand and substantially all of the nucleotides of the antisense strand are modified nucleotides, and wherein the sense strand is conjugated to a ligand attached at the 3'-terminus.

In certain embodiments, at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative or a dodecanoic acid bisdecylamide group.

In certain embodiments, the modified nucleotides is/are independently selected from the group consisting of a 2'-O-methyl modified nucleotide, a nucleotide comprising a 5'-phosphorothioate group, a 3'-terminal deoxy-thymine (dT) nucleotide, and a terminal nucleotide linked to a cholesteryl derivative or a dodecanoic acid bisdecylamide group. In certain embodiments, the modified nucleotide is selected from the group consisting of a 2'-deoxy-2'-fluoro modified nucleotide, a 2'-deoxy-modified nucleotide, a 3'-terminal deoxy-thymine (dT) nucleotide, a locked nucleotide, an abasic nucleotide, a 2'-amino-modified nucleotide, a 2'-alkyl-modified nucleotide, a morpholino nucleotide, a phosphoramidate, and a non-natural base comprising nucleotide.

In certain embodiments, the double stranded RNAi agent comprises a region of complementarity at least 17 nucleotides in length. In certain embodiments, the double stranded RNAi agent comprises a region of complementarity 19-23 nucleotides in length. In certain embodiments, the double stranded RNAi agent comprises a region of complementarity 19-21 nucleotides in length. In certain embodiments, the double stranded RNAi agent comprises a region of complementarity is 19 nucleotides in length. In certain embodiments, the double stranded RNAi agent comprises a region of complementarity is 21 nucleotides in length.

In certain embodiments, each strand of the double stranded RNAi agent is no more than 30 nucleotides in length. In certain embodiments, the double stranded RNAi agent is at least 15 nucleotides in length.

In some embodiments, at least one strand of the dsRNA agent comprises a 3' overhang of at least 1 nucleotide, e.g., at least one strand comprises a 3' overhang of at least 2 nucleotides, e.g., 2, 3, 4, 5, 6, 7, 9, 10, 11, 12, 13, 14, or 15 nucleotides. In some embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In some embodiments, both the 3' and the 5' end of one strand of the RNAi agent comprise an overhang of at least 1 nucleotide. In some embodiments, at least one strand comprises a 3' overhang of at least 2 nucleotides.

In certain embodiments, the double stranded RNAi agent further comprises a ligand. In certain embodiments, the ligand is conjugated to the 3' end of the sense strand of the double stranded RNAi agent. In certain embodiments, the ligand is an N-acetylgalactosamine (GalNAc) derivative.

In certain embodiments, the ligand is

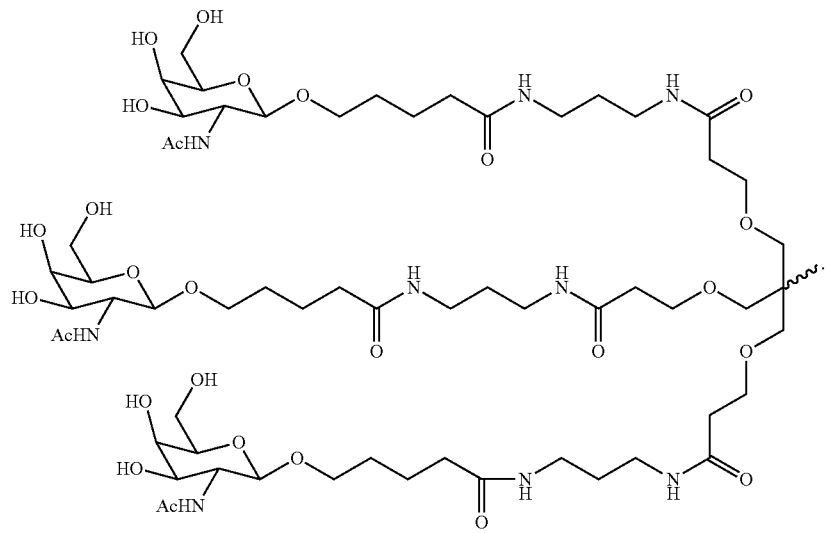 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In certain embodiments, the wherein the double stranded RNAi agent is conjugated to the ligand as shown in the following schematic

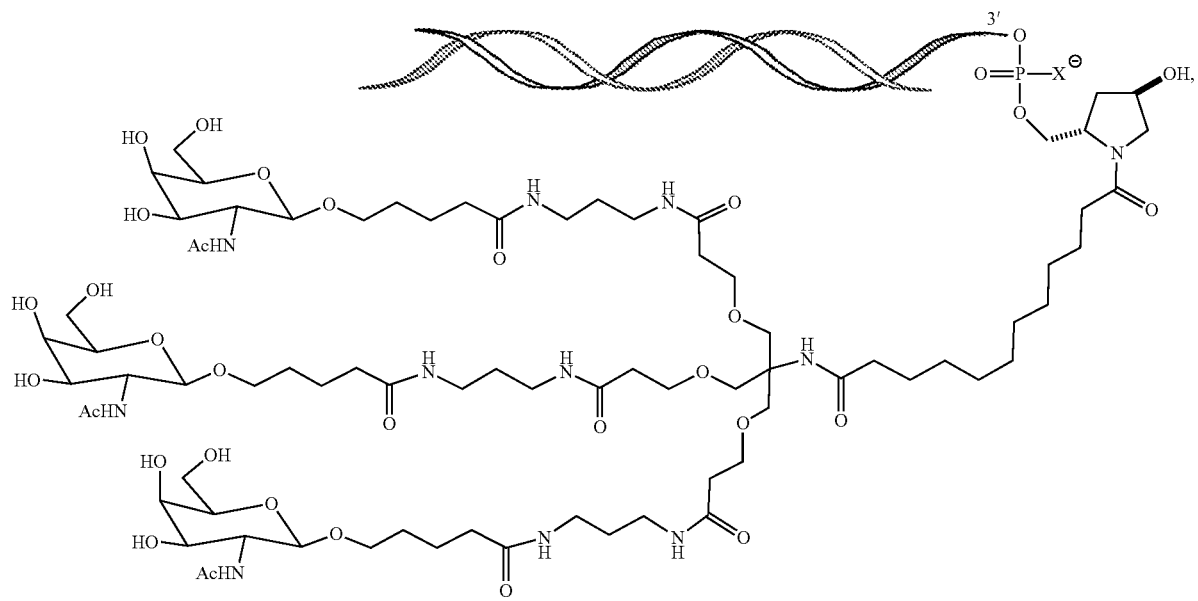

and, wherein X is O or S.

In certain embodiments, the ligand is a cholesterol.

In certain embodiments, the ligand is one or more Gal-NAc derivatives attached through a monovalent, a bivalent, or a trivalent branched linker. The ligand may be conjugated to the 3' end of the sense strand of the polynucleotide agent, the 5' end of the sense strand of the polynucleotide agent, the 3' end of the antisense strand of the polynucleotide agent, the 5' end of the antisense strand of the polynucleotide agent.

In some embodiments, the polynucleotide agents of the invention comprise a plurality, e.g., 2, 3, 4, 5, or 6, of GalNAc, each independently attached to a plurality of nucleotides of the polynucleotide agent through a plurality of monovalent linkers.

In one embodiment, the agents inhibit the expression of GCK and the sense strand and the antisense strand comprise nucleotide sequences selected from the group consisting of the nucleotide sequences of any one of the agents listed in any one of Tables 2, 3, 6, and 7.

The invention provides cells containing the double stranded RNAi agents provided herein.

In another aspect, the invention provides pharmaceutical composition for inhibiting expression of a glucokinase (GCK) gene comprising the double stranded RNAi agent provided herein. In certain embodiments, the pharmaceutical compositions further comprise a lipid formulation.

The invention also provides methods of inhibiting expression of a glucokinase (GCK) gene in a cell. The methods include contacting the cell with a double stranded RNAi agent described herein; and maintaining the cell produced for a time sufficient to obtain degradation of the mRNA transcript of a GCK gene, thereby inhibiting expression of the GCK gene in the cell.

In certain embodiments, the cell is within a subject. In certain embodiments, the subject is a human. In certain embodiments, the human subject suffers from a disease or disorder that would benefit from reduction in GCK expression, such as a glycogen storage disease (GSD), e.g., type Ia GSD. In certain embodiments, the GCK expression is inhibited by at least about 5%, 10%, 15%, 20%, 25%, 30%, about 40%, about 50%, about 60%, about 70%, about 80%, about 90%, about 95%, about 98% or about 100%.

The invention further provides methods of treating a subject having a disorder that would benefit from reduction in expression of a glucokinase (GCK) gene. The methods include administering to the subject a therapeutically effective amount of any of the double stranded RNAi agents provided herein, thereby treating the subject, such as a disease or disorder associated with a glycogen storage disease (GSD), e.g., type Ia GSD.

In one aspect, the present invention provides methods of preventing at least one symptom in a subject having a disease or disorder that would benefit from reduction in expression of a glucokinase (GCK) gene. The methods include administering to the subject a prophylactically effective amount of a double stranded RNAi agent described herein, thereby preventing at least one symptom in the subject having a disorder that would benefit from reduction in GCK expression.

In certain embodiments, administration of the double stranded RNAi agent to the subject causes an increase in one or more blood glucose and/or a decrease in GCK protein accumulation. In certain embodiments, administration of the double stranded RNAi agent to the subject, e.g., a subject having a glycogen storage disease (GSD), e.g., type Ia GSD, causes a decrease in one or more signs of a glycogen storage disease (GSD), e.g., type Ia GSD, e.g., hypoglycemia, lactic acidosis, hyperuricemia, hyperlipidemia, hepatomegaly, kidney disease as a result of glycogen accumulation, hunger, jitteriness, lethargy, apnea, seizures, diaphoresis, confusion, headaches, dizziness, unusual mood or behavior changes, loss of consciousness, coma, muscle cramps, bleeding diathesis, short stauture, osteoporosis, delayed puberty, gout, renal disease, systemic hypertension, pulmonary hypertension, hepatic adenomas, pancreatitis, anemia, vitamin D deficiency, polycystic ovaries, irregular menstrual cycles, menorrhagia, and/or eruptive xanthomata.

The invention also provides methods of inhibiting the expression of a glucokinase (GCK) gene in a subject. The methods include method administering to the subject a therapeutically effective amount of any of the double stranded RNAi agents provided herein or a pharmaceutical composition comprising any of the double stranded RNAi agents provided herein, thereby inhibiting the expression of GCK in the subject.

In one aspect, the present invention provides methods of increasing the blood glucose levels, e.g., fasting blood glucose levels, in a subject having a disease or disorder that would benefit from reduction in GCK expression. The methods include administering to the subject a therapeutically effective amount of any of the double stranded RNAi agents provided herein or a pharmaceutical composition comprising any of the double stranded RNAi agents provided herein, thereby increasing the blood glucose levels in the subject.

In another aspect, the present invention provides methods of decreasing plasma lactate levels in a subject having a disease or disorder that would benefit from reduction in GCK expression. The methods include administering to the subject a therapeutically effective amount of any of the double stranded RNAi agents provided herein or a pharmaceutical composition comprising any of the double stranded RNAi agents provided herein, thereby decreasing the blood lactate levels in the subject.

In yet another aspect, the present invention provides methods of decreasing plasma uric acid levels in a subject having a disease or disorder that would benefit from reduction in GCK expression. The methods include administering to the subject a therapeutically effective amount of any of the double stranded RNAi agents provided herein or a pharmaceutical composition comprising any of the double stranded RNAi agents provided herein, thereby decreasing the plasma uric acidlevels in the subject.

In one aspect, the present invention provides methods of decreasing plasma triglyceride levels in a subject having a disease or disorder that would benefit from reduction in GCK expression. The methods include administering to the subject a therapeutically effective amount of any of the double stranded RNAi agents provided herein or a pharmaceutical composition comprising any of the double stranded RNAi agents provided herein, thereby decreasing plasma triglyceride levels in the subject.

In another aspect, the present invention provides methods of decreasing total plasma cholesterol levels in a subject having a disease or disorder that would benefit from reduction in GCK expression. The methods include administering to the subject a therapeutically effective amount of any of the double stranded RNAi agents provided herein or a pharmaceutical composition comprising any of the double stranded RNAi agents provided herein, thereby decreasing the total plasma cholesterol levels in said subject.

In one aspect, the present invention provides methods of decreasing hepatomegaly in a subject having a disease or disorder that would benefit from reduction in GCK expression. The methods include administering to the subject a therapeutically effective amount of any of the double stranded RNAi agents provided herein or a pharmaceutical composition comprising any of the double stranded RNAi agents provided herein, thereby decreasing hepatomegaly in the subject.

In certain embodiments, the dsRNA agent is administered to the subject at a dose of about 0.01 mg/kg to about 10 mg/kg or about 0.5 mg/kg to about 50 mg/kg. In certain embodiments, the dsRNA agent is administered about once per month, once every other two months, or once a quarter (i.e., once every three months), for example, at a dose of about 0.1 mg/kg to about 5.0 mg/kg.

In certain embodiments, the double stranded RNA agent is administered to the subject once a week. In certain embodiments, the dsRNA agent is administered to the subject once a month. In certain embodiments, the dsRNA agent is administered once per quarter (i.e., every three months).

In some embodiments, the methods of the invention further include administering an additional therapeutic to the subject. In one embodiment, the additional therepaeutic is a sodium-glucose co-transporter 2 (SGLT2) inhibitor, e.g., Dapagliflozin, Canagliflozin, Ipragliflozin (ASP-1941), Tofogliflozin, Empagliflozin, Sergliflozin etabonate, Remogliflozin etabonate (BHV091009), and Ertugliflozin (PF-04971729/MK-8835.

In yet another aspect, the invention provides kits for performing the methods of the invention. In one aspect, the invention provides a kit for performing a method for inhibiting expression of a glucokinase (GCK) gene in a cell by contacting a cell with a double stranded RNAi agent in an amount effective to inhibit expression of the GCK in the cell. The kit comprises an RNAi agent and instructions for use and, optionally, means for administering the RNAi agent to a subject.

DETAILED DESCRIPTION OF THE INVENTION

The present invention provides iRNA compositions, which affect the RNA-induced silencing complex (RISC)-mediated cleavage of RNA transcripts of a glucokinase (GCK) gene. The GCK gene may be within a cell, e.g., a cell within a subject, such as a human. The present invention also provides methods of using the iRNA compositions of the invention for inhibiting the expression of a glucokinase (GCK) gene and/or for treating a subject having a disorder that would benefit from inhibiting or reducing the expression of a GCK gene, such as a glycogen storage disease (GSD), e.g., type Ia GSD, and one or more of the signs or symptoms associated therewith.

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a GCK gene.

In certain embodiments, the iRNAs of the invention include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of a GCK gene. These iRNAs with the longer length antisense strands include a second RNA strand (the sense strand) of 20-60 nucleotides in length wherein the sense and antisense strands form a duplex of 18-30 contiguous nucleotides.

The use of these iRNAs enables the targeted degradation of mRNAs of a GCK gene in mammals. Very low dosages of GCK iRNAs, in particular, can specifically and efficiently mediate RNA interference (RNAi), resulting in significant inhibition of expression of a GCK gene. Using cell-based assays, the present inventors have demonstrated that iRNAs targeting GCK can mediate RNAi, resulting in significant inhibition of expression of a GCK gene. Thus, methods and compositions including these iRNAs are useful for treating a subject who would benefit by a reduction in the levels and/or activity of a GCK protein, such as a subject having a glycogen storage disease (GSD), e.g., type Ia GSD.

The following detailed description discloses how to make and use compositions containing iRNAs to inhibit the expression of a GCK gene, as well as compositions and methods for treating subjects having diseases and disorders that would benefit from inhibition and/or reduction of the expression of this gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to". The term "or" is used herein to mean, and is used interchangeably with, the term "and/or," unless context clearly indicates otherwise.

The term "about" is used herein to mean within the typical ranges of tolerances in the art. For example, "about" can be understood as within about 2 standard deviations from the mean. In certain embodiments, about means +10%. In certain embodiments, about means +5%. When about is present before a series of numbers or a range, it is understood that "about" can modify each of the numbers in the series or range.

The terms "GCK," "glucokinase," "hexokinase D," and "hexokinase 4" refer to an enzyme that facilitates phosphorylation of glucose to glucose-6-phosphate having an amino acid sequence from any vertebrate or mammalian source, including, but not limited to, human, bovine, chicken, rodent, mouse, rat, porcine, ovine, primate, monkey, and guinea pig, unless specified otherwise. The term also refers to fragments and variants of native GCK that maintain at least one in vivo or in vitro activity of a native GCK. The term encompasses full-length unprocessed precursor forms of GCK as well as mature forms resulting from, e.g., post-translational processing.

The sequence of a human GCK mRNA transcript (transcript variant 2) can be found at, for example, GenBank Accession No. GI: 15967158 (NM_033507; NCBI GeneID: 2645; SEQ ID NO:1). The sequence of another human GCK mRNA transcript (transcript variant 1) can be found at, for example, GenBank Accession No. GI: 167621407 (NM_000162); SEQ ID NO:2). The sequence of yet another human GCK mRNA transcript (transcript variant 3) can be found at, for example, GenBank Accession No. GI: 15967160 (NM_033508); SEQ ID NO:3). The predicted sequence of a rhesus GCK mRNA transcript (transcript variant X1) can be found at, for example, GenBank Accession No. GI: 544420246 (XM_005549685; SEQ ID NO:4). The predicted sequence of another rhesus GCK mRNA transcript (transcript variant X2) can be found at, for example, GenBank Accession No. GI: 544420248 (XM_005549686; SEQ ID NO:5). The predicted sequence of yet another rhesus GCK mRNA transcript (transcript variant X3) can be found at, for example, GenBank Accession No. GI: 544420250 (XM_005549687; SEQ ID NO:6). The predicted sequence of another rhesus GCK mRNA transcript (transcript variant X4) can be found at, for example, GenBank Accession No. GI: 544420252 (XM_005549688; SEQ ID NO:7). The sequence of a mouse GCK mRNA transcript (transcript variant 1) can be found at, for example, GenBank Accession No. GI: 565671706 (NM_010292; SEQ ID NO:8). The sequence of another mouse GCK mRNA transcript (transcript variant 2) can be found at, for example, GenBank Accession No. GI: 565671714 (NM_001287386; SEQ ID NO:9). The sequence of a rat GCK mRNA transcript (transcript variant 2) can be found at, for example, GenBank Accession No. GI: 399220372 (NM_012565; SEQ ID NO:10). The sequence of another rat GCK mRNA transcript (transcript variant 1) can be found at, for example, GenBank Accession No. GI: 399220370 (NM_001270849; SEQ ID NO:11). The sequence of yet another rat GCK mRNA transcript (transcript variant 3) can be found at, for example, GenBank Accession No. GI: 399220373 (NM_001270850; SEQ ID NO:12). Additional examples of GCK mRNA sequences are readily available using publicly available databases, e.g., GenBank, UniProt, and OMIM.

As used herein, "target sequence" refers to a contiguous portion of the nucleotide sequence of an mRNA molecule formed during the transcription of a GCK gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a GCK gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA," "RNAi agent," "iRNA agent," and "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of GCK in a cell, e.g., a cell within a subject, such as a mammalian subject.

In one embodiment, an RNAi agent of the invention includes a single stranded RNAi that interacts with a target RNA sequence, e.g., a GCK target mRNA sequence, to direct the cleavage of the target RNA. Without wishing to be bound by theory it is believed that long double stranded RNA introduced into cells is broken down into double stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (ssRNA) (the antisense strand of an siRNA duplex) generated within a cell and which promotes the formation of a RISC complex to effect silencing of the target gene, i.e., a GCK gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "iRNA" for use in the compositions and methods of the invention is a double stranded RNA and is referred to herein as a "double stranded RNAi agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a GCK gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

The majority of nucleotides of each strand of a dsRNA molecule may be ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23, or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA, each strand of which comprises 19-23 nucleotides, that interacts with a target RNA sequence, e.g., a GCK gene, without wishing to be bound by theory, long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188). In one embodiment, an RNAi agent of the invention is a dsRNA of 24-30 nucleotides that interacts with a target RNA sequence, e.g., a prolyl hydroxylase domain-containing gene, i.e., a PHD1 target mRNA sequence, a PHD2 target mRNA sequence, or a PHD3 target mRNA sequence, to direct the cleavage of the target RNA.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In another embodiment, one or more of the nucleotides in the overhang is replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double stranded over its entire length.

The term "antisense strand" or "guide strand" refers to the strand of an iRNA, e.g., a dsRNA, which includes a region that is substantially complementary to a target sequence, e.g., a GCK mRNA. As used herein, the term "region of complementarity" refers to the region on the antisense strand that is substantially complementary to a sequence, for example a target sequence, e.g., a GCK nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the iRNA.

The term "sense strand" or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding GCK). For example, a polynucleotide is complementary to at least a part of a GCK mRNA if the sequence is substantially complementary to a non-interrupted portion of an mRNA encoding GCK.

Accordingly, in some embodiments, the antisense strand polynucleotides disclosed herein are fully complementary to the target GCK sequence. In other embodiments, the antisense strand polynucleotides disclosed herein are substantially complementary to the target GCK sequence and comprise a contiguous nucleotide sequence which is at least about 80% complementary over its entire length to the equivalent region of the nucleotide sequence of SEQ ID NO:1, or a fragment of SEQ ID NO:1, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target GCK sequence and comprise a contiguous nucleotide sequence which is at least about 80% complementary over its entire length to any one of the sense strand nucleotide sequences in any one of Tables 2, 3, 6, and 7, or a fragment of any one of the sense strand nucleotide sequences in any one of Tables 2, 3, 6, and 7, such as at least 85%, 90%, 95% complementary, or 100% complementary.

In one embodiment, an RNAi agent of the invention includes a sense strand that is substantially complementary to an antisense polynucleotide which, in turn, is complementary to a target GCK sequence, and wherein the sense strand polynucleotide comprises a contiguous nucleotide sequence which is at least about 80% complementary over its entire length to the equivalent region of the nucleotide sequence of SEQ ID NO:5, or a fragment of any one of SEQ ID NO:5, such as about 85%, about 86%, about 87%, about 88%, about 89%, about 90%, about % 91%, about 92%, about 93%, about 94%, about 95%, about 96%, about 97%, about 98%, or about 99% complementary.

The term "inhibiting," as used herein, is used interchangeably with "reducing," "silencing," "downregulating," "suppressing" and other similar terms, and includes any level of inhibition.

The phrase "inhibiting expression of a GCK," as used herein, includes inhibition of expression of any GCK gene (such as, e.g., a mouse GCK gene, a rat GCK gene, a monkey GCK gene, or a human GCK gene) as well as variants or mutants of a GCK gene that encode a GCK protein.

"Inhibiting expression of a GCK gene" includes any level of inhibition of a GCK gene, e.g., at least partial suppression of the expression of a GCK gene, such as an inhibition by at least about 20%. In certain embodiments, inhibition is by at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of a GCK gene may be assessed based on the level of any variable associated with GCK gene expression, e.g., GCK mRNA level or GCK protein level. The expression of a GCK may also be assessed indirectly based on, e.g., blood glucose levels, serum ketone body levels, and/or serum fatty acid levels. Inhibition may be assessed by a change in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In one embodiment, at least partial suppression of the expression of a GCK gene, is assessed by a reduction of the amount of GCK mRNA which can be isolated from or detected in a first cell or group of cells in which a GCK gene is transcribed and which has or have been treated such that the expression of a GCK gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an RNAi agent," such as a dsRNA, as used herein, includes contacting a cell by any possible means. Contacting a cell with an RNAi agent includes contacting a cell in vitro with the iRNA or contacting a cell in vivo with the iRNA. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., GalNAc3, that directs the RNAi agent to a site of interest, e.g., the liver. Combinations of in vitro and in vivo methods of contacting are also possible. For example, a cell may also be contacted in vitro with an RNAi agent and subsequently transplanted into a subject.

In one embodiment, contacting a cell with an iRNA includes "introducing" or "delivering the iRNA into the cell" by facilitating or effecting uptake or absorption into the cell. Absorption or uptake of an iRNA can occur through unaided diffusive or active cellular processes, or by auxiliary agents or devices. Introducing an iRNA into a cell may be in vitro and/or in vivo. For example, for in vivo introduction, iRNA can be injected into a tissue site or administered systemically. In vivo delivery can also be done by a beta-glucan delivery system, such as those described in U.S. Pat. Nos. 5,032,401 and 5,607,677, and U.S. Publication No. 2005/0281781, the entire contents of which are hereby incorporated herein by reference. In vitro introduction into a cell includes methods known in the art such as electroporation and lipofection. Further approaches are described herein below and/or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). It is understood that the sequence of the GCK gene must be sufficiently complementary to the antisense strand of the iRNA agent for the agent to be used in the indicated species.

In an embodiment, the subject is a human, such as a human being treated or assessed for a disease, disorder or condition that would benefit from reduction in GCK expression; a human at risk for a disease, disorder or condition that would benefit from reduction in GCK expression; a human having a disease, disorder or condition that would benefit from reduction in GCK expression; and/or human being treated for a disease, disorder or condition that would benefit from reduction in GCK expression as described herein.

As used herein, the terms "treating" or "treatment" refer to a beneficial or desired result including, such as increasing blood glucose levels in a subject. The terms "treating" or "treatment" also include, but are not limited to, alleviation or amelioration of one or more symptoms of a glycogen storage disease (GSD), e.g., type Ia GSD, or at least one sign or symptom associated with GSD, such as hypoglycemia, lactic acidosis, hyperuricemia, hyperlipidemia, hepatomegaly, kidney disease as a result of glycogen accumulation, hunger, jitteriness, lethargy, apnea, seizures, diaphoresis, confusion, headaches, dizziness, unusual mood or behavior changes, loss of consciousness, coma, muscle cramps, bleeding diathesis, short stauture, osteoporosis, delayed puberty, gout, renal disease, systemic hypertension, pulmonary hypertension, hepatic adenomas, pancreatitis, anemia, vitamin D deficiency, polycystic ovaries, irregular menstrual cycles, menorrhagia, and eruptive xanthomata.

"Treatment" can also mean prolonging survival as compared to expected survival in the absence of treatment.

By "lower" in the context of a disease marker or symptom is meant a statistically significant decrease in such level. The decrease can be, for example, at least 10%, at least 20%, at least 30%, at least 40%, or more, down to a level accepted as within the range of normal for an individual without such disorder, or to below the level of detection of the assay. In certain embodiments, the decrease is down to a level accepted as within the range of normal for an individual without such disorder which can also be referred to as a normalization of a level. For example, lowering cholesterol to 180 mg/dl or lower would be considered to be within the range of normal for a subject. A subject having a cholesterol level of 230 mg/dl with a cholesterol level decreased to 210 mg/dl would have a cholesterol level that was decreased by 40% towards normal (230−210/230−180=20/50=40% reduction). In certain embodiments, the reduction is the normalization of the level of a sign or symptom of a disease, a reduction in the difference between the subject level of a sign of the disease and the normal level of the sign for the disease (e.g., to the upper level of normal when the value for the subject must be decreased to reach a normal value, and to the lower level of normal when the value for the subject must be increased to reach a normal level). In certain embodiments, the methods include a clinically relevant inhibition of expression of a GCK gene, e.g. as demonstrated by a clinically relevant outcome after treatment of a subject with an agent to reduce the expression of a GCK gene.

As used herein, "prevention" or "preventing," when used in reference to a disease, disorder or condition thereof, that would benefit from a reduction in expression of a GCK gene, refers to a reduction in the likelihood that a subject will develop a symptom associated with such disease, disorder, or condition, e.g., a glycogen storage disease (GSD), e.g., type Ia GSD. The likelihood of developing type Ia GSD is reduced, for example, when an individual having one or more risk factors for type Ia GSD, e.g., a genetic disorder, either fails to develop type Ia GSD, or signs or symptoms thereof, or develops type Ia GSD, or signs or symptoms thereof, with less severity relative to a population having the same risk factors and not receiving treatment as described herein.

The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months, or years) is considered effective prevention. Prevention can require administration of more than one dose of an agent described herein.

As used herein, the term "blood glucose level" refers to the level of glucose present in blood as determined by any routine method known in the art. It is understood that the glucose level in a subject sample is dependent on, for example, whether the subject has had a meal, whether the subject has fasted, the time of day and the level of activity of the subject. Therefore, the glucose level must be compared to an appropriate control to determine if the glucose level is, in fact, altered from a normal level or from a level obtained from the subject at an earlier time point, e.g., prior to treatment. In general, blood glucose levels, e.g., fasting blood glucose levels, in a subject that does not have a disease or disorder that would benefit from reduction in the levels of GCK as described herein is about 70 to about 120 mg/dL.

As used herein, the term "plasma lactate level" refers to the level of lactate present in blood as determined by any routine method known in the art. It is understood that the lactate level in a subject sample is dependent on, for example, whether the subject has fasted, the time of day and the level of activity of the subject. Therefore, the lactate level must be compared to an appropriate control to determine if the lactate level is, in fact, altered from a normal level or from a level obtained from the subject at an earlier time point, e.g., prior to treatment. In general, plasma lactate levels in a subject that does not have a disease or disorder that would benefit from reduction in the levels of GCK as described herein is about 0.5 to about 2.2 mmol/L.

As used herein, the term "plasma uric acid level" refers to the level of uric acid present in blood as determined by any routine method known in the art. It is understood that the lactate level in a subject sample is dependent on, for example, whether the subject has fasted, the time of day and the level of activity of the subject. Therefore, the uric acid level must be compared to an appropriate control to determine if the uric acid level is, in fact, altered from a normal level or from a level obtained from the subject at an earlier time point, e.g., prior to treatment. In general, plasma uric acid levels in a subject that does not have a disease or disorder that would benefit from reduction in the levels of GCK as described herein is about 2.0 to about 5.0 mg/dL.

As used herein, the term "plasma triglyceride level" refers to the level of triglycerides present in blood as determined by any routine method known in the art. It is understood that the triglyceride level in a subject sample is dependent on, for example, whether the subject has fasted, the time of day and the level of activity of the subject.

Therefore, the triglyceride level must be compared to an appropriate control to determine if the triglyceride level is, in fact, altered from a normal level or from a level obtained from the subject at an earlier time point, e.g., prior to treatment. In general, plasma triglyceride levels in a subject that does not have a disease or disorder that would benefit from reduction in the levels of GCK as described herein is about 150 to about 200 mg/dL.

As used herein, the term "total cholesterol level" refers to the level of high density lipoprotein (HDL) plus low density lipoprotein (LDL) plus 20% of the triglyceride level as determined by any routine method known in the art. It is understood that the total cholesterol level in a subject sample is dependent on, for example, whether the subject has fasted, the time of day and the level of activity of the subject. Therefore, the total cholesterol level must be compared to an appropriate control to determine if the total cholesterol level is, in fact, altered from a normal level or from a level obtained from the subject at an earlier time point, e.g., prior to treatment. In general, plasma cholesterol levels in a subject that does not have a disease or disorder that would benefit from reduction in the levels of GCK as described herein is about 100 to about 200 mg/dL.

As used herein, the term "hepatomegaly" refers to swelling of the liver beyond its normal size as determined by any routine method known in the art. It is understood that the size and weight of the liver in a subject that does not have a disease or disorder that would benefit from reduction in the levels of GCK as described herein increases with age and body weight. Sex and body shape also influence the size of the liver, e.g., by percussion, the mean liver size is about 7.5 centimeters in adult women and about 10.5 centimeters in adult men; it may be about 3 centimeters larger or smaller and still be normal.

As used herein, a "disease or disorder that would benefit from reduction in GCK expression" is a disease or disorder associated with or caused by a clinically relevant hypoglycemia. For example, this term includes any disorder, disease or condition resulting in one or more signs or symptoms of a glycogen storage disease (GSD), e.g., type Ia GSD, including, but not limited to, hypoglycemia, lactic acidosis, hyperuricemia, hyperlipidemia, hepatomegaly, kidney disease as a result of glycogen accumulation, hunger, jitteriness, lethargy, apnea, seizures, diaphoresis, confusion, headaches, dizziness, unusual mood or behavior changes, loss of consciousness, coma, muscle cramps, bleeding diathesis, short stauture, osteoporosis, delayed puberty, gout, renal disease, systemic hypertension, pulmonary hypertension, hepatic adenomas, pancreatitis, anemia, vitamin D deficiency, polycystic ovaries, irregular menstrual cycles, menorrhagia, and eruptive xanthomata. In certain embodiments, a "disease or disorder that would benefit from reduction in GCK expression" meets the diagnostic requirements of a type Ia GSD.

"Glycogen storage disease" or "GSD" is an inherited genetic disorder due to an absence or deficiency of one of the enzymes responsible for making or breaking down glycogen in the body. This enzyme deficiency causes either abnormal tissue concentrations of glycogen or incorrectly or abnormally formed glycogen. There are about 11 known types of GSD, which are classified based on the missing or defective enzymes. For example, Type Ia GSD, the most common form of GSD, is caused by a genetic defect in the enzyme glucose-6-phosphatase. Hepatomegaly due to inappropriate glycogen accumulation and various metabolic disarrangements from inappropriate glucose-6-phosphate metabolism are predominant features of many of the various glycogen storage diseases, such as Types Ia, Ib, III, IV, VI and IX. Symptoms of GSD vary based on the enzyme that is missing and usually result from the buildup of glycogen or from the inability to produce glucose when needed. Glycogen storage disease is usually diagnosed in infancy or childhood, e.g., at about age 3-4. Affected children typically present with hepatomegaly, lactic acidosis, hyperuricemia, hyperlipidemia, hypertriglyceridemia and/or hypoglycemic seizures. Further, affected children often have doll-like faces with fat cheeks, relatively thin extremities, short stature, and protuberant abdomen. Xanthoma and diarrhea may be present. Impaired platelet function can lead to a bleeding tendency with frequent epistaxis. The diagnostic criteria for GSD, e.g., type Ia GSD, include, for example, fasting blood glucose concentration lower than 60 mg/dL; plasma lactate higher than 2.5 mmol/L; plasma uric acid higher than 5.0 mg/dL; triglycerides higher than 250 mg/dL; total plasma cholesterol higher than 200 mg/dL; administration of glucagon or epinephrine (i.e., a glucagon or epinephrine challenge test) causes little or no increase in blood glucose concentration, but both increase serum lactate concentrations significantly; histopathologic liver findings which include distention of the liver cells by glycogen and fat; PAS positive and diastase sensitive glycogen that is uniformly distributed within the cytoplasm; normal or only modestly increased glycogen; and large and numerous lipid vacuoles; biallelic mutations in either G6PC (GSDIa) or SLC37A4 (GSDIb) (Veiga-da-Cunha et al (1998) *Am J Hum Genet.* 63:976-83; Chou et al (2002) *Hum Mutat.* 29:921-30; Matern et al (2002) *Eur J Pediatr.* 161 Suppl 1:S10-9; Rake et al (2002) *Eur J Pediatr.* 161 Suppl 1:S20-34; and Ekstein et al (2004) *Am J Med Genet.* 129A:162-4); deficient, e.g., (lower than 10% of normal) glucose-6-phosphatase (G6Pase) catalytic activity (the normal G6Pase enzyme activity level in liver is 3.50±0.8 µmol/min/g tissue, although in rare individuals with milder clinical manifestations, the G6Pase enzyme activity can be higher, e.g., >1.0 µmol/min/g tissue and <2.0 µmol/min/g tissue.

"Therapeutically effective amount," as used herein, is intended to include the amount of an RNAi agent that, when administered to a subject having a glycogen storage disease (GSD), e.g., type Ia GSD, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an iRNA that, when administered to a subject having a glycogen storage disease (GSD), e.g., type Ia GSD, is sufficient to prevent or ameliorate the disease or one or more symptoms of the disease. Ameliorating the disease includes slowing the course of the disease or reducing the severity of later-developing disease. The "prophylactically effective amount" may vary depending on the iRNA, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to blood drawn from the subject or plasma isolated therefrom, saliva, or urine, typically a 24 hour urine sample.

II. iRNAs of the Invention

Described herein are iRNAs which inhibit the expression of a GCK gene. In one embodiment, the iRNA agent includes double stranded ribonucleic acid (dsRNA) molecules for inhibiting the expression of a GCK gene in a cell, such as a cell within a subject, e.g., a mammal, such as a human having a glycogen storage disease (GSD), e.g., type Ia GSD. The dsRNA includes an antisense strand having a region of complementarity which is complementary to at least a part of an mRNA formed in the expression of a GCK gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the GCK gene, the iRNA inhibits the expression of the GCK gene (e.g., a human, a primate, a non-primate, or a bird GCK gene) by at least about 10% as assayed by, for example, a PCR or branched DNA (bDNA)-based method, or by a protein-based method, such as by immunofluorescence analysis, using, for example, western blotting, or flowcytometric techniques. In preferred embodiments, inhibition of expression is determined by the qPCR method provided in the examples. For in vitro assessment of activity, percent inhibition is determined using the methods provided herein at a single dose at, for example, a 10 nM duplex final concentration. For in vivo studies, the level after treatment can be compared to, for example, an appropriate historical control or a pooled population sample control to determine the level of reduction, e.g., when a baseline value is no available for the subject.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a GCK gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is between about 15 and about 23 nucleotides in length, or between about 25 and about 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target GCK expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end, or both ends of either an antisense or sense strand of a dsRNA. In certain embodiments, longer, extended overhangs are possible.

A dsRNA can be synthesized by standard methods known in the art as further discussed below, e.g., by use of an automated DNA synthesizer, such as are commercially available from, for example, Biosearch™, Applied Biosystems™, Inc.

iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In certain aspects, a dsRNA of the invention includes at least two nucleotide sequences, a sense sequence and an anti-sense sequence. The sense strand sequence is selected from the group of sequences provided in any of Tables 2, 3, 6, and 7 and the corresponding nucleotide sequence of the antisense strand of the sense strand is selected from the group of sequences provided in any of Tables 2, 3, 6, and 7. In this aspect, one of the two sequences is complementary to the other of the two sequences, with one of the sequences being substantially complementary to a sequence of an mRNA generated in the expression of a GCK gene. As such, in this aspect, a dsRNA will include two oligonucleotides, where one oligonucleotide is described as the sense strand in any of Tables 2, 3, 6, and 7, and the second oligonucleotide is described as the corresponding antisense strand of the sense strand in any of Tables 2, 3, 6, and 7. In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 3 and 7 are described as modified and/or conjugated sequences, the RNA of the iRNA of the invention e.g., a dsRNA of the invention, may comprise any one of the sequences set forth in any one of Tables 3 and 7 that is un-modified, un-conjugated, and/or modified and/or conjugated differently than described therein.

In another aspect, a double stranded ribonucleic acid (dsRNA) of the invention for inhibiting expression of GCK comprises, consists essentially of, or consists of a sense strand and an antisense strand, wherein the sense strand comprises the nucleotide sequence of a sense strand in any of Tables 2, 3, 6, and 7 and the antisense strand comprises the nucleotide sequence of the corresponding antisense strand in any of Tables 2, 3, 6, and 7.

The skilled person is well aware that dsRNAs having a duplex structure of between about 20 and 23 base pairs, e.g., 21, base pairs have been hailed as particularly effective in inducing RNA interference (Elbashir et al., (2001) *EMBO J.*, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of a GCK gene by not more than about 5, 10, 15, 20, 25, or 30% inhibition from a dsRNA comprising the full sequence, are contemplated to be within the scope of the present invention.

In addition, the RNAs described herein identify a site(s) in a GCK transcript that is susceptible to RISC-mediated cleavage. As such, the present invention further features iRNAs that target within this site(s). As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided herein coupled to additional nucleotide sequences taken from the region contiguous to the selected sequence in a GCK gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified herein represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified herein, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA agent as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of a GCK gene, generally does not contain any mismatch within the central 13 nucleotides. The methods described herein or methods known in the art can be used to determine whether an iRNA containing a mismatch to a target sequence is effective in inhibiting the expression of a GCK gene. Consideration of the efficacy of iRNAs with mismatches in inhibiting expression of a GCK gene is important, especially if the particular region of complementarity in a GCK gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified. iRNAs of the invention in which "substantially all of the nucleotides are modified" are largely but not wholly modified and can include not more than 5, 4, 3, 2, or 1 unmodified nucleotides. The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages.

Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. No. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside);

siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—$N(CH_3)$—O—$CH_2$— [known as a methylene (methylimino) or MMI backbone], —$CH_2$—O—$N(CH_3)$—$CH_2$—, —$CH_2$—$N(CH_3)$—$N(CH_3)$—$CH_2$— and —$N(CH_3)$—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)$—$NH_2$, $O(CH_2)_nCH_3$, $O(CH_2)$—$ONH_2$, and $O(CH_2)$—$ON[(RCH_2)_n CH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition*, 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12): 3185-3193).

In some embodiments, the iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

The RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C (CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.*, 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative U.S. patents and US patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH (CH3)-O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., (1989) *Proc. Natl. Acid. Sci. USA*, 86: 6553-6556), cholic acid (Manoharan et al., (1994) *Biorg. Med. Chem. Let.*, 4:1053-1060), a thioether, e.g., beryl-S-tritylthiol (Manoharan et al., (1992) *Ann. N.Y. Acad. Sci.*, 660:306-309; Manoharan et al., (1993) *Biorg. Med. Chem. Let.*, 3:2765-2770), a thiocholesterol (Oberhauser et al., (1992) *Nucl. Acids Res.*, 20:533-538), an aliphatic chain, e.g., dodecandiol or undecyl residues (Saison-Behmoaras et al., (1991) *EMBO J,* 10:1111-1118;

Kabanov et al., (1990) *FEBS Lett.,* 259:327-330; Svinarchuk et al., (1993) *Biochimie,* 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.,* 36:3651-3654; Shea et al., (1990) *Nucl. Acids Res.,* 18:3777-3783), a polyamine or a polyethylene glycol chain (Manoharan et al., (1995) *Nucleosides & Nucleotides,* 14:969-973), or adamantane acetic acid (Manoharan et al., (1995) *Tetrahedron Lett.,* 36:3651-3654), a palmityl moiety (Mishra et al., (1995) *Biochim. Biophys. Acta,* 1264:229-237), or an octadecylamine or hexylaminocarbonyloxycholesterol moiety (Crooke et al., (1996) *J. Pharmacol. Exp. Ther.,* 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, mucin carbohydrate, multivalent lactose, monovalent or multivalent galactose, N-acetyl-galactosamine, N-acetyl-gulucosamine multivalent mannose, multivalent fucose, glycosylated polyaminoacids, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, ligands include monovalent or multivalent galactose. In certain embodiments, ligands include cholesterol.

Other examples of ligands include dyes, intercalating agents (e.g. acridines), cross-linkers (e.g. psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems™ (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 25). An RFGF analogue (e.g., amino acid sequence AALLPVLLAAP (SEQ ID NO: 26) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 27) and the *Drosophila* Antennapedia protein (RQIKIWFQNRRMKWKK (SEQ ID NO: 28) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature*, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glyciosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, a α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen, or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen, or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is a monosaccharide.

In one embodiment, a carbohydrate conjugate for use in the compositions and methods of the invention is selected from the group consisting of:

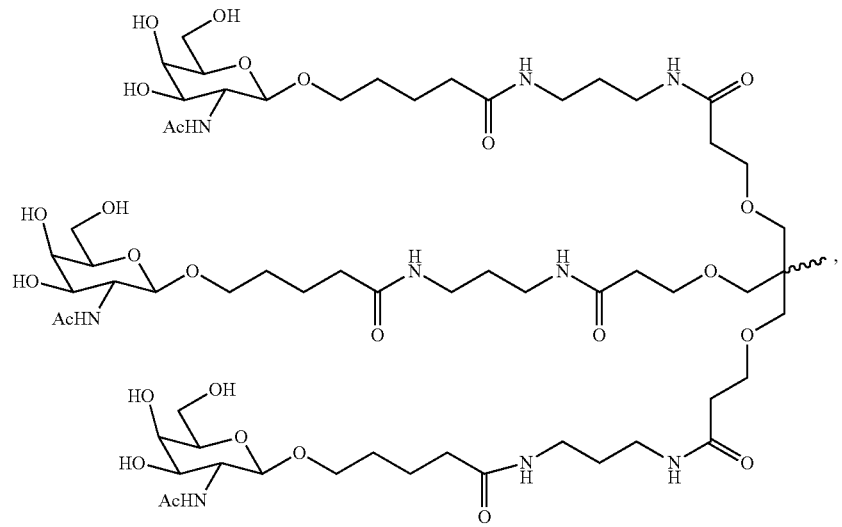

Formula II

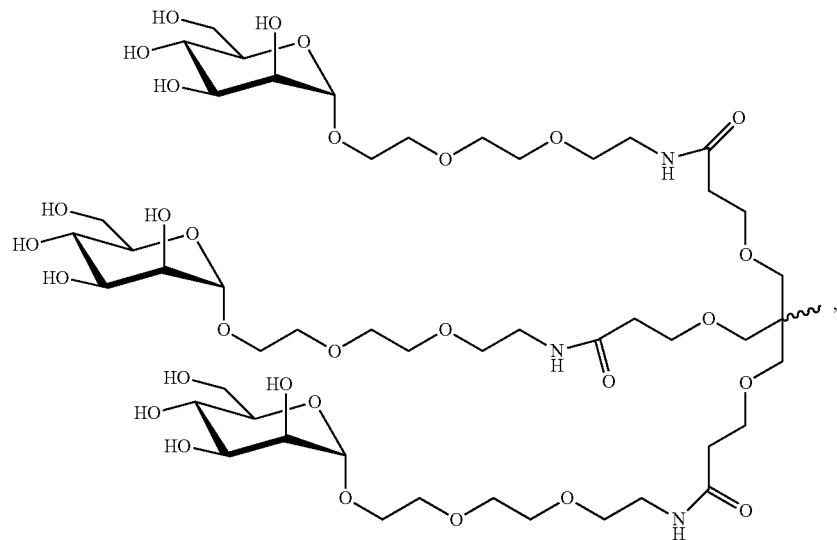

Formula III

Formula IV
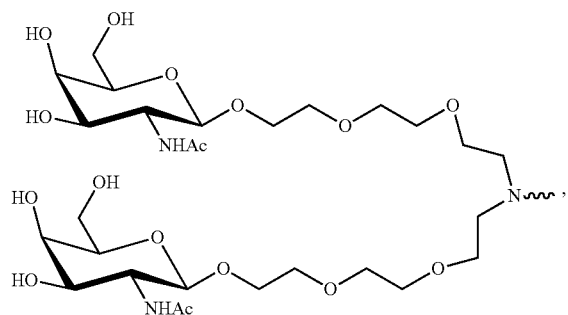
Formula V
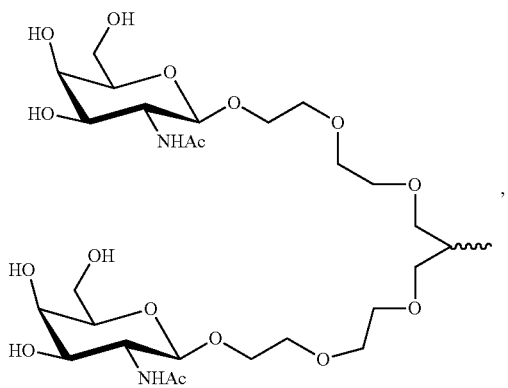
Formula VI
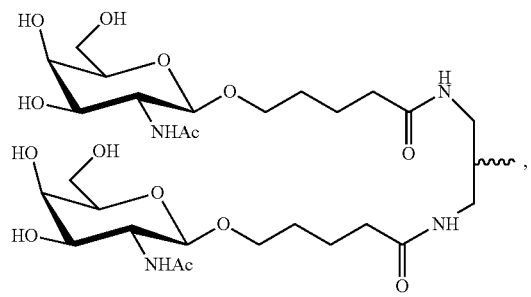
Formula VII
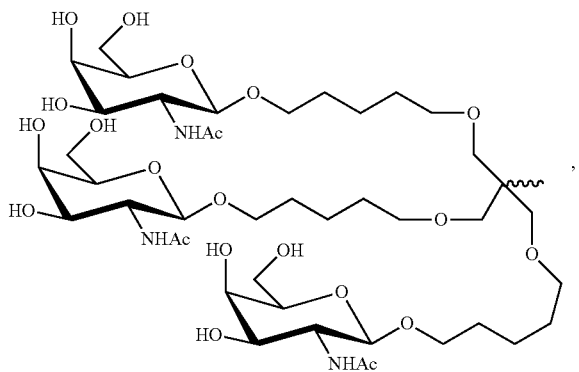
Formula VIII
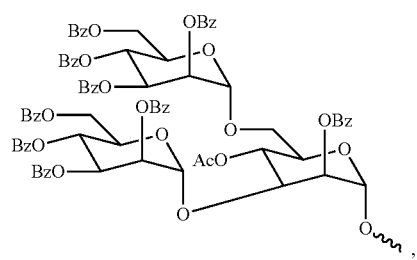
Formula IX
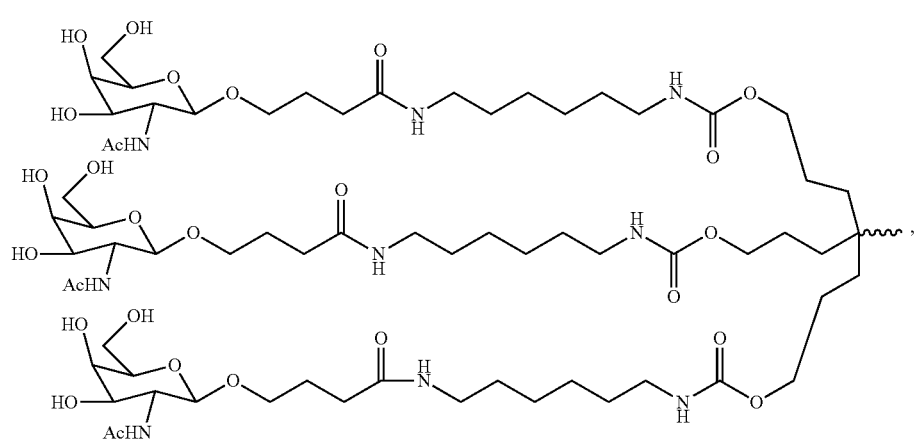

Formula X
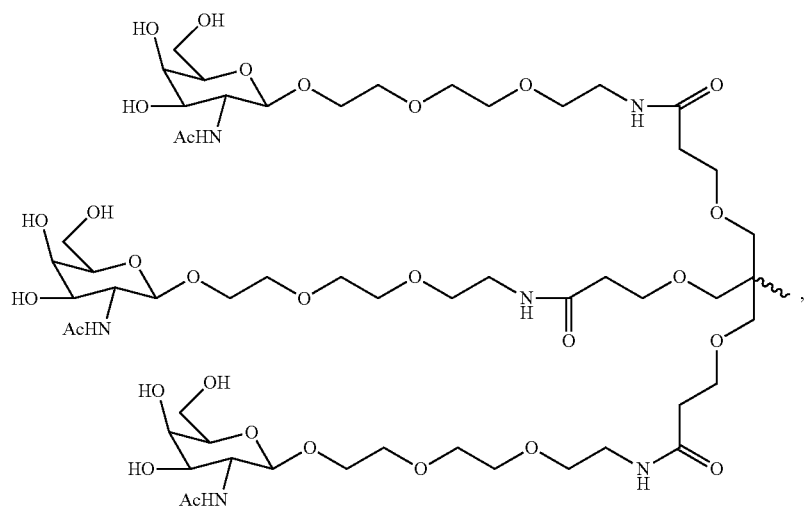
Formula XI
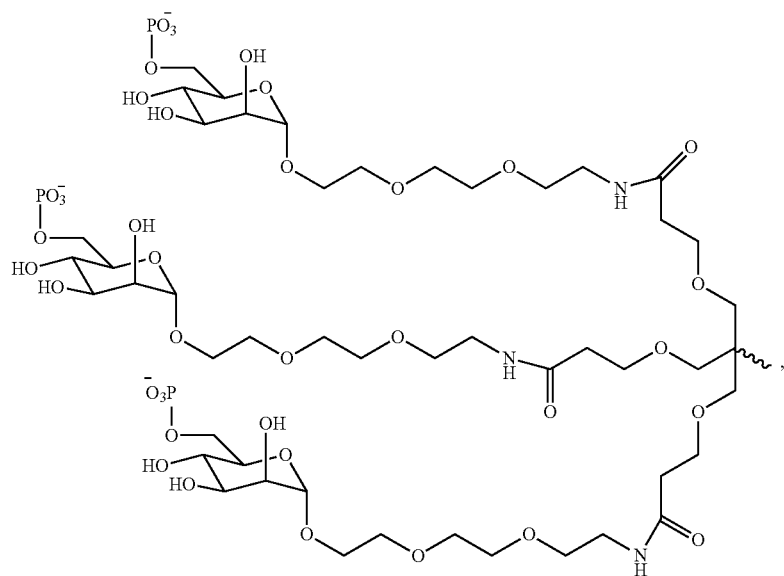

Formula XII
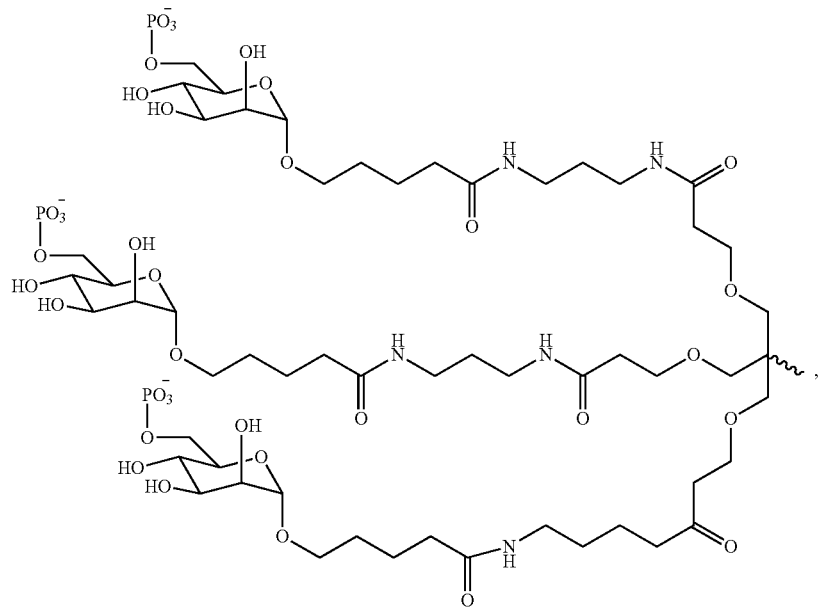
Formula XIII
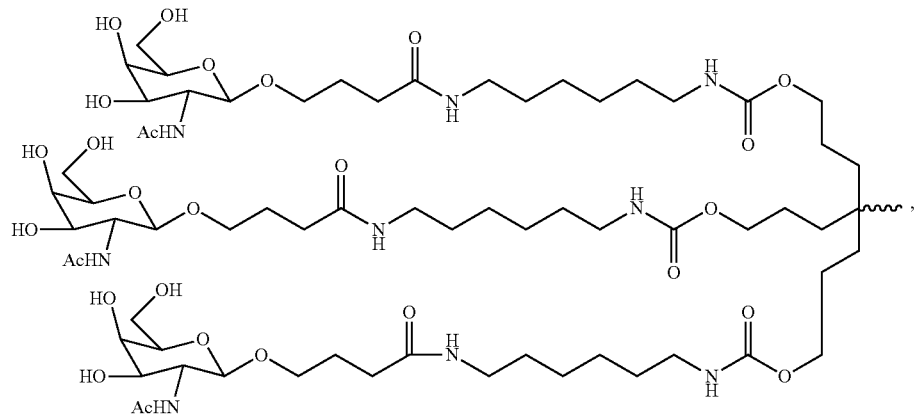
Formula XIV
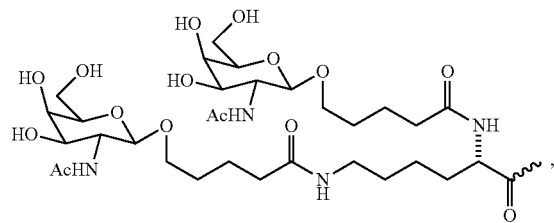
Formula XV
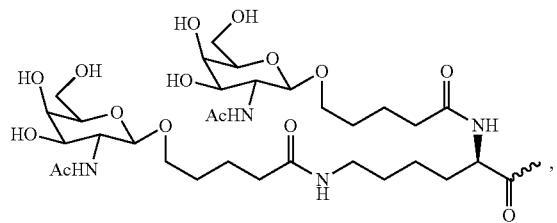
Formula XVI
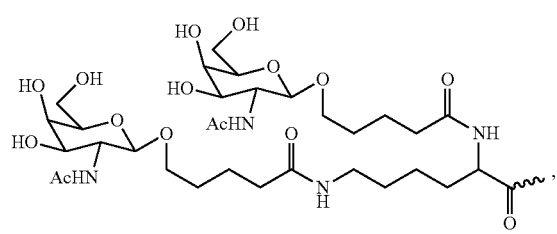
Formula XVII
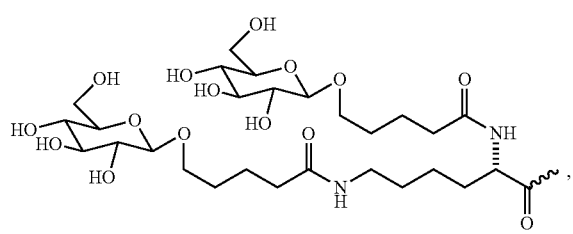

-continued
Formula XVIII
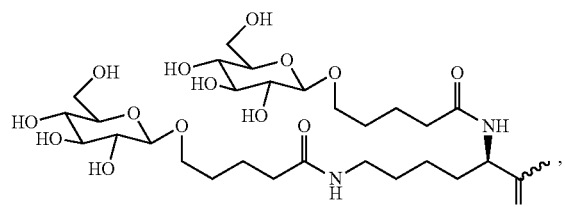
Formula XIX
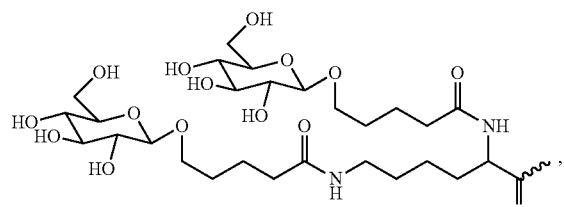
Formula XX
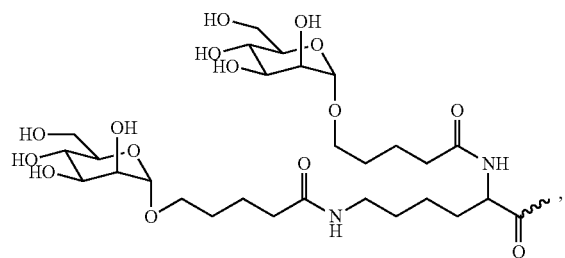
Formula XXI
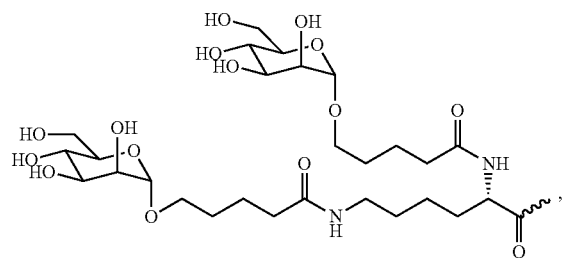
Formula XXII
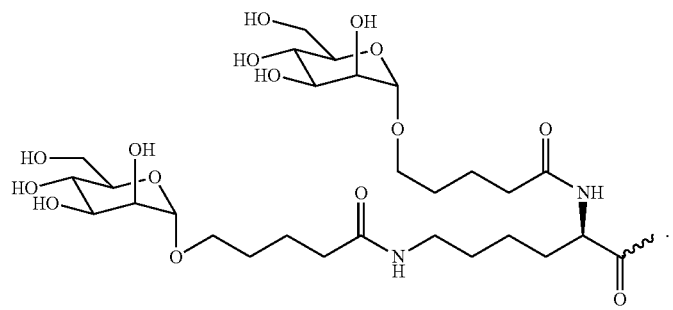
In one embodiment, the monosaccharide is an N-acetyl-galactosamine, such as
Formula II
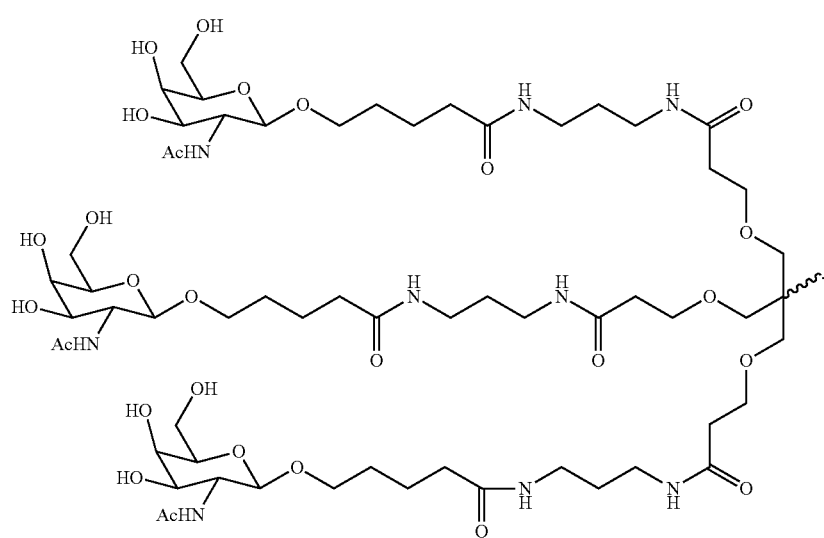
Another representative carbohydrate conjugate for use in the embodiments described herein includes, but is not limited to, (Formula XXIII)
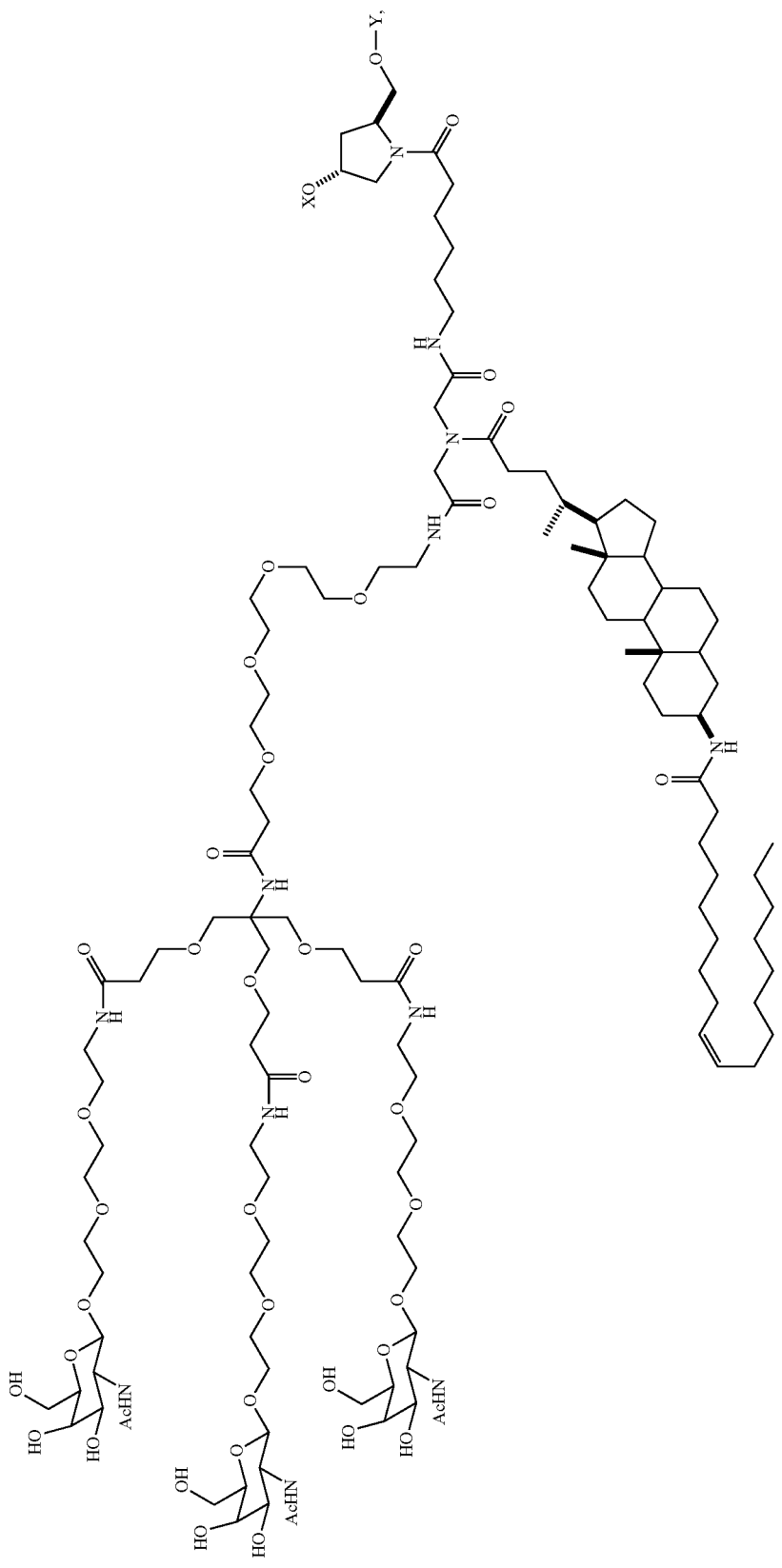

when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one GalNAc or GalNAc derivative attached to the iRNA agent. In another embodiment, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the carbohydrate conjugate further comprises one or more additional ligands as described above, such as, but not limited to, a PK modulator and/or a cell permeation peptide.

Additional carbohydrate conjugates (and linkers) suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, NR8, C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene, and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides, etc.) and polypeptides. Peptide-based cleavable groups do not include the amide group (—C(O)NH—). The amide group can be formed between any alkylene, alkenylene, or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formula XXIV)
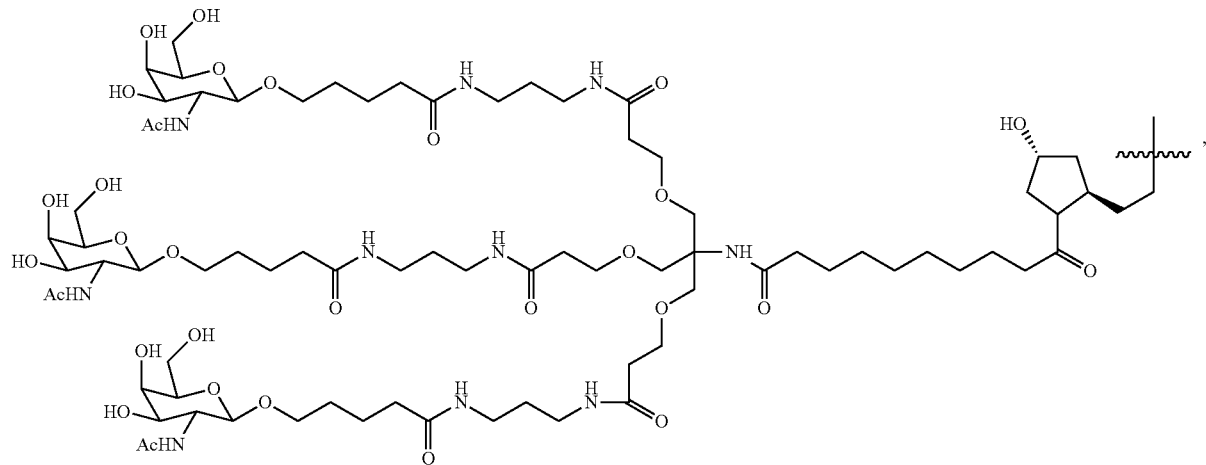
(Formula XXV)
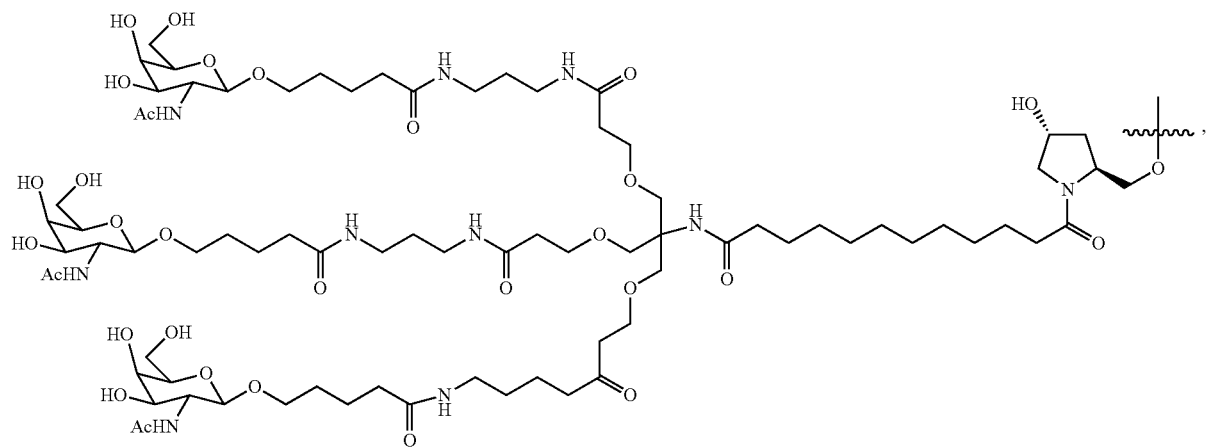
(Formula XXVI)
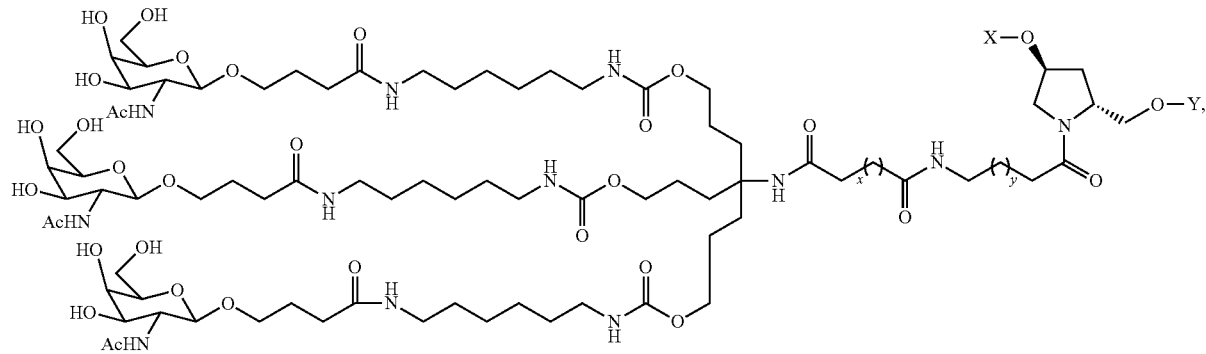
x = 1-30
y = 1-15

(Formula XXVII)
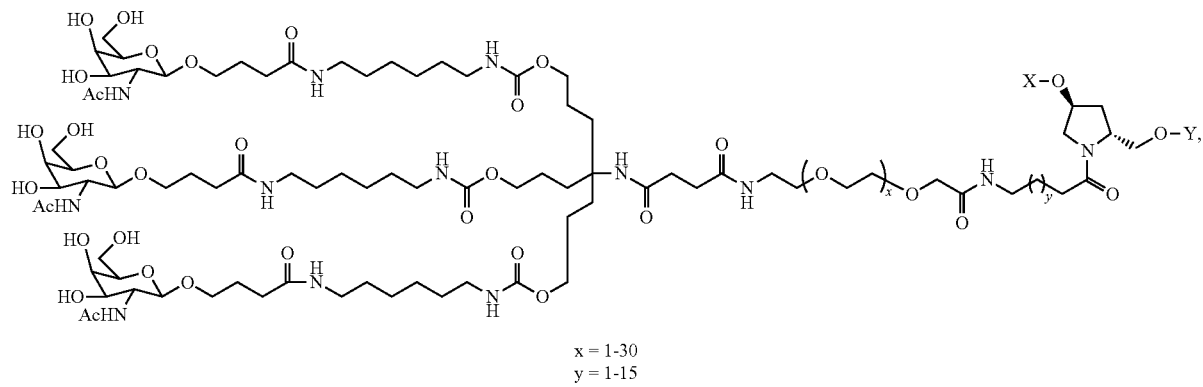
x = 1-30
y = 1-15
(Formula XXVIII)
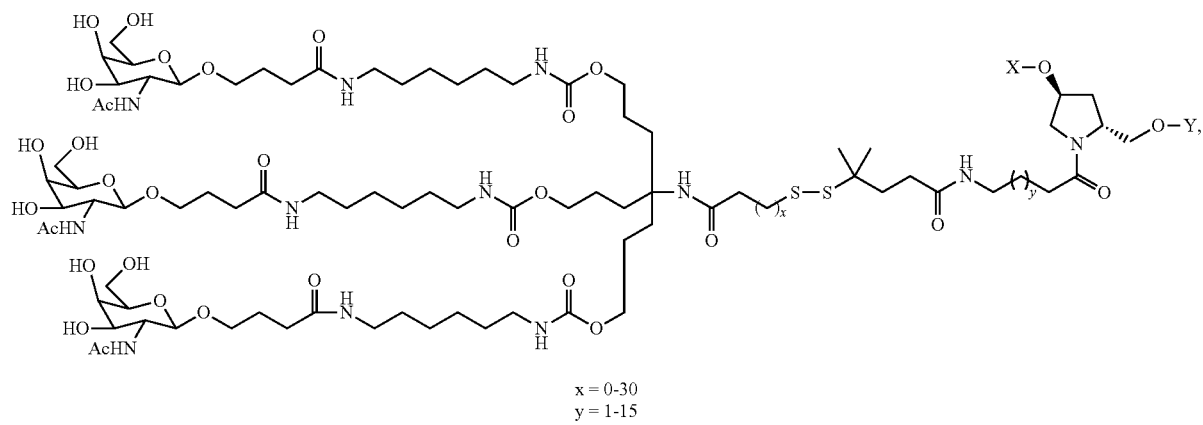
x = 0-30
y = 1-15
(Formula XXIX)
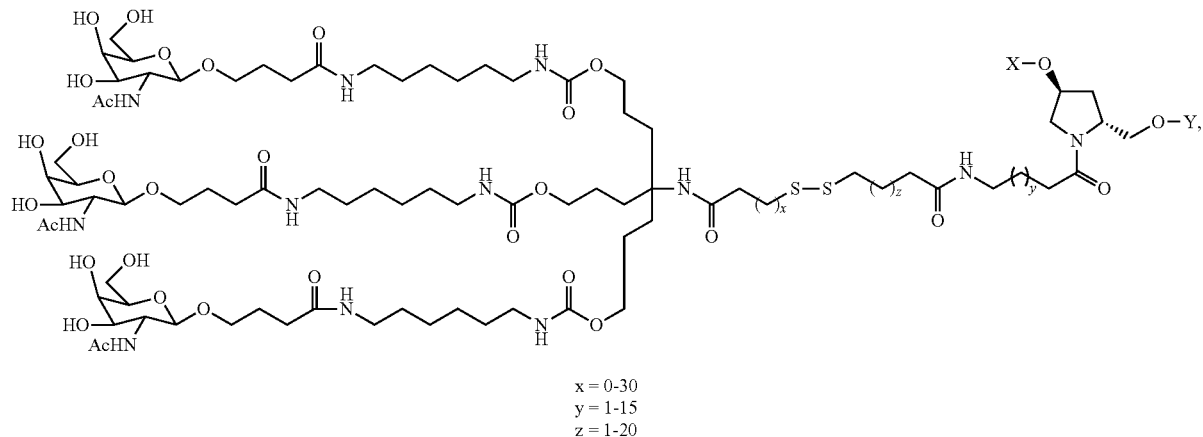
x = 0-30
y = 1-15
z = 1-20

-continued (Formula XXX)

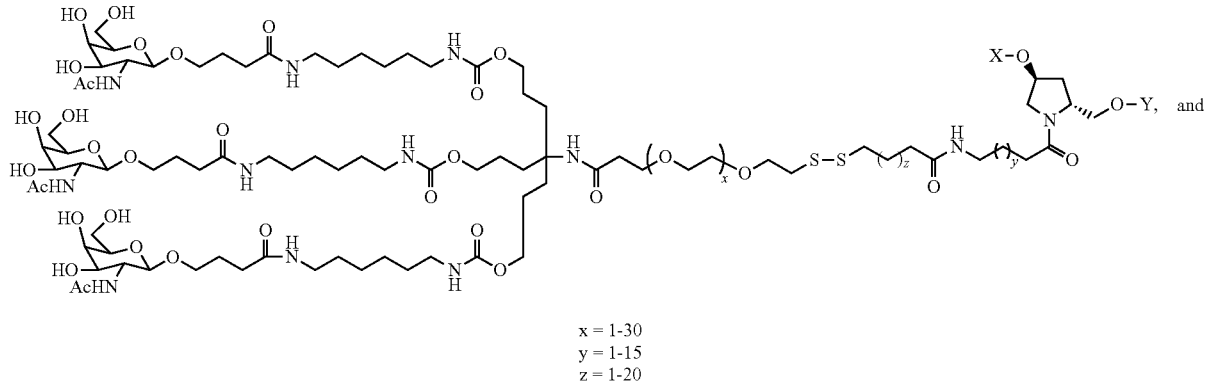

x = 1-30
y = 1-15
z = 1-20

(Formula XXXI)

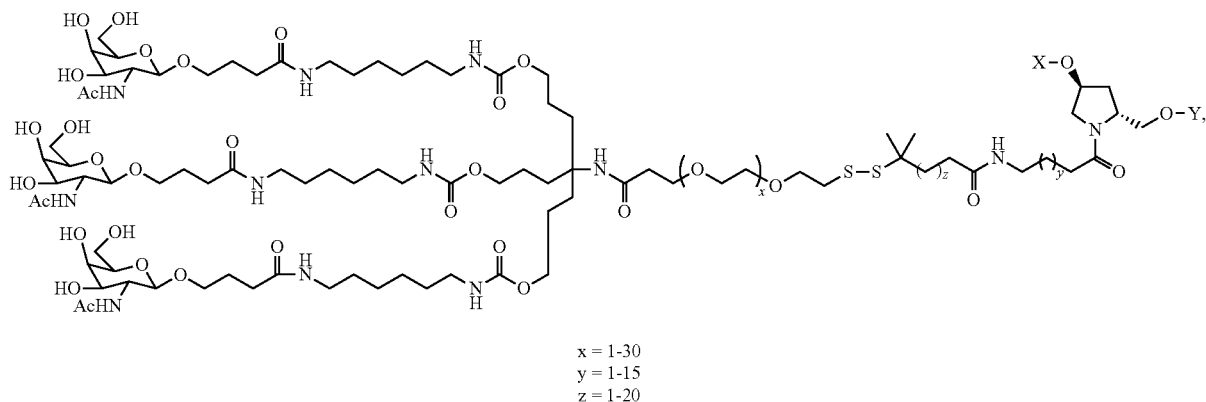

x = 1-30
y = 1-15
z = 1-20 when one of X or Y is an oligonucleotide, the other is a hydrogen.

In certain embodiments of the compositions and methods of the invention, a ligand is one or more GalNAc (N-acetyl-galactosamine) derivatives attached through a bivalent or trivalent branched linker.

In one embodiment, a dsRNA of the invention is conjugated to a bivalent or trivalent branched linker selected from the group of structures shown in any of formula (XXXII)-(XXXV):

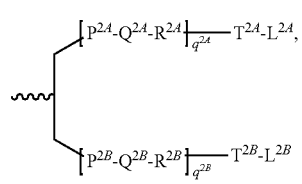

Formula XXXII

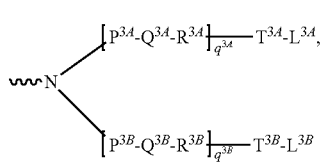

Formula XXXIII

-continued

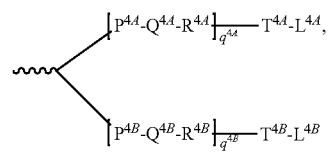

Formula XXXIV

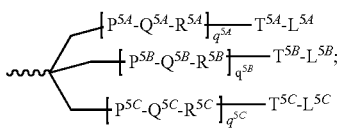

Formula XXXV wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O); $R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—CH($R^a$)—NH—, CO,

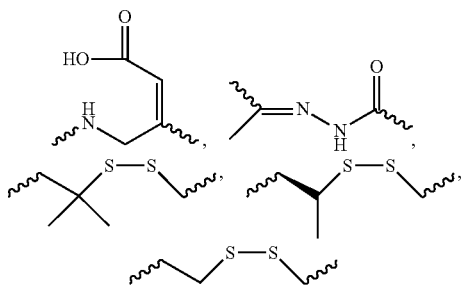

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXVI):

Formula XXXVI

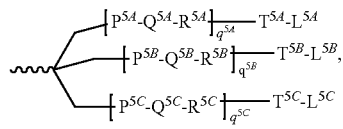

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Lett., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an amino linker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject having a glycogen storage disease (GSD), e.g., type Ia GSD) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian RL., (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J. et al., (2004) *Retina* 24:132-138) and subretinal injections in mice (Reich, S J. et al. (2003) *Mol. Vis.* 9:210-216) were both shown to prevent neovascularization in an experimental model of age-related macular degeneration. In addition, direct intratumoral injection of a dsRNA in mice reduces tumor volume (Pille, J. et al. (2005) *Mol. Ther.* 11:267-274) and can prolong survival of tumor-bearing mice (Kim, W J. et al., (2006) *Mol. Ther.* 14:343-350; Li, S. et al., (2007) *Mol. Ther.* 15:515-523). RNA interference has also shown success with local delivery to the CNS by direct injection (Dorn, G. et al., (2004) *Nucleic Acids* 32:e49; Tan, P H. et al. (2005) *Gene Ther.* 12:59-66; Makimura, H. et al. (2002) *BMC Neurosci.* 3:18; Shishkina, G T., et al. (2004) *Neuroscience* 129:521-528; Thakker, E R., et al. (2004) *Proc. Natl. Acad. Sci. U.S.A.* 101:17270-17275; Akaneya, Y., et al. (2005) *J. Neurophysiol.* 93:594-602) and to the lungs by intranasal administration (Howard, K A. et al., (2006) *Mol. Ther.* 14:476-484; Zhang, X. et al., (2004) *J. Biol. Chem.* 279:10677-10684; Bitko, V. et al., (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of an iRNA to an aptamer has been shown to inhibit tumor growth and mediate tumor regression in a mouse model of prostate cancer (McNamara, JO. et al., (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim SH. et al., (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al. (2003) *J. Mol. Biol* 327: 761-766; Verma, U N. et al., (2003) *Clin. Cancer Res.* 9:1291-1300; Arnold, A S et al., (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the GCK gene can be expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of a GCK gene, such as, a glycogen storage disease (GSD), e.g., type Ia GSD, or one or more signs or symptoms of GSD, such as hypoglycemia, lactic acidosis, hyperuricemia, hyperlipidemia, hepatomegaly, kidney disease as a result of glycogen accumulation, hunger, jitteriness, lethargy, apnea, seizures, diaphoresis, confusion, headaches, dizziness, unusual mood or behavior changes, loss of consciousness, coma, muscle cramps, bleeding diathesis, short stature, osteoporosis, delayed puberty, gout, renal disease, systemic hypertension, pulmonary hypertension, hepatic adenomas, pancreatitis, anemia, vitamin D deficiency, polycystic ovaries, irregular menstrual cycles, menorrhagia, and eruptive xanthomata.

Such pharmaceutical compositions are formulated based on the mode of delivery. One example is compositions that are formulated for systemic administration via parenteral delivery, e.g., by intravenous (IV) or for subcutaneous delivery. Another example is compositions that are formulated for direct delivery into the liver, e.g., by infusion into the liver, such as by continuous pump infusion.

The pharmaceutical compositions of the invention may be administered in dosages sufficient to inhibit expression of a GCK gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of 0.1 mg/kg to about 5.0 mg/kg, preferably about 0.3 mg/kg and about 3.0 mg/kg. A repeat-dose regimine may include administration of a therapeutic amount of iRNA on a regular basis, such as every other day or once a year. In certain embodiments, the iRNA is administered about once per month to about once per quarter (i.e., about once every three months).

After an initial treatment regimen, the treatments can be administered on a less frequent basis.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as disorders of excess glucose that would benefit from reduction in the expression of GCK.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration can include transdermal patches, ointments, lotions, creams, gels, drops, suppositories, sprays, liquids, and powders. Conventional pharmaceutical carriers, aqueous, powder, or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents, and surfactants. Suitable lipids and liposomes include neutral (e.g., dioleoylphosphatidyl DOPE ethanolamine, dimyristoylphosphatidyl choline DMPC, distearolyphosphatidyl choline), negative (e.g., dimyristoylphosphatidyl glycerol DMPG), and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride or diglyceride; or pharmaceutically acceptable salt thereof. Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNAi. In some cases the liposomes are also specifically targeted, e.g., to direct the iRNA to particular cell types.

A liposome containing a RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., (1987) *Proc. Natl. Acad. Sci. USA* 8:7413-7417; U.S. Pat. Nos. 4,897,355; 5,171,678; Bangham et al., (1965) *M. Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.*, 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release*, 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S.T.P.-.Pharma. Sci.,* 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters*, 223:42; Wu et al., (1993) *Cancer Research*, 53:3765).

Various liposomes comprising one or more glycolipids are known in the art. Papahadjopoulos et al. (*Ann. N.Y. Acad. Sci.*, (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85:6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., (1987) *Proc. Natl. Acad. Sci. USA* 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ (Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim™, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega™, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical™, La Jolla, Calif.) and Lipofectamine™ (DOSPA) (Life Technology™, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) *Journal of Drug Targeting*, vol. 2,405-410 and du Plessis et al., (1992) *Antiviral Research*, 18:259-265; Mannino, R. J. and Fould-Fogerite, S., (1998) *Biotechniques* 6:682-690; Itani, T. et al., (1987) *Gene* 56:267-276; Nicolau, C. et al. (1987) *Meth. Enzymol.* 149:157-176; Straubinger, R. M. and Papahadjopoulos, D. (1983) *Meth. Enzymol.* 101:512-527; Wang, C. Y. and Huang, L., (1987) *Proc. Natl. Acad. Sci. USA* 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading. Transfersomes have been used to deliver serum albumin to the skin. The transfersome-mediated delivery of serum albumin has been shown to be as effective as subcutaneous injection of a solution containing serum albumin.

Other formulations amenable to the present invention are described in, for example, PCT Publication No. WO 2008/042973.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines, and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether, and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoyl-phosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol; or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($Ci_2$), a PEG-dimyristyloxypropyl ($Ci_4$), a PEG-dipalmityloxypropyl (Ci6), or a PEG-distearyloxypropyl ($C]_8$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see US20090023673, filed Mar. 26, 2008, which is incorporated herein by reference), Cholesterol (Sigma-Aldrich™), and PEG-Ceramide C16 (Avanti™ Polar Lipids) can be used to prepare lipid-dsRNA nanoparticles (i.e., LNP01 particles). Stock solutions of each in ethanol can be prepared as follows: ND98, 133 mg/ml; cholesterol, 25 mg/ml, PEG-Ceramide C16, 100 mg/ml. The ND98, cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

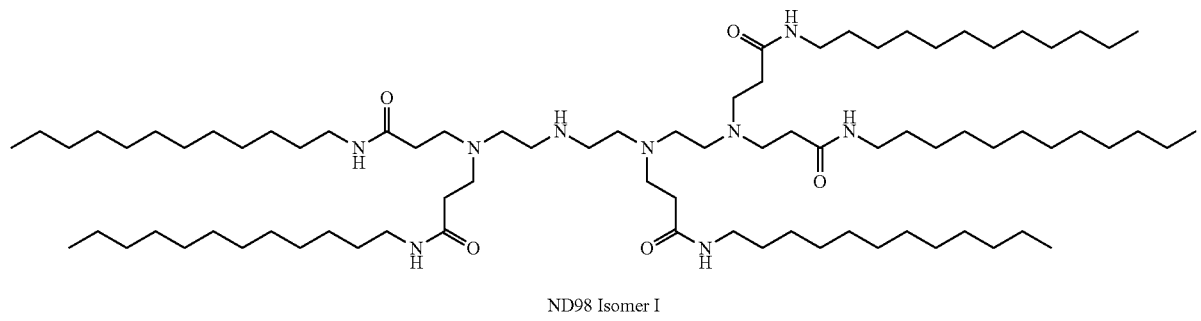

ND98 Isomer I

LNP01 formulations are described, e.g., in International Application Publication No. WO 2008/042973, which is hereby incorporated by reference.

Additional exemplary lipid-dsRNA formulations are described in the table below.

| | Ionizable/Cationic Lipid | cationic lipid/non-cationic lipid/cholesterol/PEG-lipid conjugate<br>Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA<br>(57.1/7.1/34.4/1.4)<br>lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA<br>57.1/7.1/34.4/1.4<br>lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG<br>57.5/7.5/31.5/3.5<br>lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG<br>57.5/7.5/31.5/3.5<br>lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG<br>60/7.5/31/1.5,<br>lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG<br>60/7.5/31/1.5,<br>lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG<br>50/10/38.5/1.5<br>Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG<br>50/10/38.5/1.5<br>Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG<br>50/10/38.5/1.5<br>Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG<br>50/10/38.5/1.5<br>Lipid:siRNA 10:1 |
| LNP13 | XTC | XTC/DSPC/Chol/PEG-DMG<br>50/10/38.5/1.5<br>Lipid:siRNA: 33:1 |
| LNP14 | MC3 | MC3/DSPC/Chol/PEG-DMG<br>40/15/40/5<br>Lipid:siRNA: 11:1 |
| LNP15 | MC3 | MC3/DSPC/Chol/PEG-DSG/GalNAc-PEG-DSG<br>50/10/35/4.5/0.5<br>Lipid:siRNA: 11:1 |
| LNP16 | MC3 | MC3/DSPC/Chol/PEG-DMG<br>50/10/38.5/1.5<br>Lipid:siRNA: 7:1 |

-continued

|  | Ionizable/Cationic Lipid | cationic lipid/non-cationic lipid/cholesterol/PEG-lipid conjugate Lipid:siRNA ratio |
|---|---|---|
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000) SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described in, for example, PCT Publication No. WO 2010/088537, the entire contents of which are hereby incorporated herein by reference.

MC3 comprising formulations are described, e.g., in U.S. Publication No. 2010/0324120, filed Jun. 10, 2010, the entire contents of which are hereby incorporated by reference.

ALNY-100 comprising formulations are described in, for example, PCT Publication No. WO 2010/054406, the entire contents of which are hereby incorporated herein by reference.

C12-200 comprising formulations are described in, for example, PCT Publication No. WO 2010/129709, the entire contents of which are hereby incorporated herein by reference.

Compositions and formulations for oral administration include powders or granules, microparticulates, nanoparticulates, suspensions, or solutions in water or non-aqueous media, capsules, gel capsules, sachets, tablets, or minitablets. Thickeners, flavoring agents, diluents, emulsifiers, dispersing aids, or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride or a diglyceride; or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include polyamino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular, or intrahepatic administration can include sterile aqueous solutions which can also contain buffers, diluents and other suitable additives such as, but not limited to, penetration enhancers, carrier compounds, and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous, or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin, and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments, and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols, and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins, and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij™ 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, or 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex™ 300, Captex™ 355, Capmul™ MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils, and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles an RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., *Critical Reviews in Therapeutic Drug Carrier Systems,* 1991, p. 92). Such compounds are well known in the art.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney, or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone; and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents, and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone, and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents, and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, and/or aromatic substances; and the like which do not deleteriously interact with the nucleic acid(s) of the formulation.

Aqueous suspensions can contain substances which increase the viscosity of the suspension including, for example, sodium carboxymethylcellulose, sorbitol, and/or dextran. The suspension can also contain stabilizers.

In some embodiments, pharmaceutical compositions featured in the invention include (a) one or more iRNA compounds and (b) one or more agents which function by a non-RNAi mechanism and which are useful in treating a GCK-associated disorder. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the $ED_{50}$ with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by GCK expression. In any event, the administering physician can adjust the amount and timing of iRNA administration on the basis of results observed using standard measures of efficacy known in the art or described herein.

VI. Methods of the Invention

The present invention also provides methods of using an iRNA of the invention and/or a composition containing an iRNA of the invention to reduce and/or inhibit glucokinase (GCK) expression in a cell. The methods include contacting the cell with a dsRNA of the invention and maintaining the cell for a time sufficient to obtain degradation of the mRNA transcript of a GCK gene, thereby inhibiting expression of the GCK gene in the cell. Reduction in gene expression can be assessed by any methods known in the art. For example, a reduction in the expression of GCK may be determined by determining the mRNA expression level of GCK using methods routine to one of ordinary skill in the art, e.g., northern blotting, qRT-PCR; by determining the protein level of GCK using methods routine to one of ordinary skill in the art, such as western blotting, immunological techniques. A reduction in the expression of GCK may also be assessed indirectly by measuring a decrease in biological activity of GCK.

In the methods of the invention the cell may be contacted in vitro or in vivo, i.e., the cell may be within a subject.

A cell suitable for treatment using the methods of the invention may be any cell that expresses a GCK gene. A cell suitable for use in the methods of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

GCK expression is inhibited in the cell by at least about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100%. In preferred embodiments, GCK expression is inhibited by at least 20%.

The in vivo methods of the invention may include administering to a subject a composition containing an iRNA, where the iRNA includes a nucleotide sequence that is complementary to at least a part of an RNA transcript of the GCK gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of GCK, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of a GCK gene in a mammal. The methods include administering to the mammal a composition comprising a dsRNA that targets a GCK gene in a cell of the mammal and maintaining the mammal for a time sufficient to obtain degradation of the mRNA transcript of the GCK gene, thereby inhibiting expression of the GCK gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a puncture liver biopsy sample serves as the tissue material for monitoring the reduction in GCK gene and/or protein expression.

The present invention further provides methods of treatment of a subject in need thereof. The treatment methods of the invention include administering an iRNA of the invention to a subject, e.g., a subject that would benefit from a reduction and/or inhibition of GCK expression, in a therapeutically effective amount of an iRNA targeting a GCK gene or a pharmaceutical composition comprising an iRNA targeting a GCK gene.

In addition, the present invention provides methods of increasing the blood glucose levels, e.g., fasting blood glucose levels, in a subject having a disease or disorder that would benefit from a reduction in GCK expression. The methods include administering an iRNA of the invention to the subject in a therapeutically effective amount of an iRNA targeting a GCK gene or a pharmaceutical composition comprising an iRNA targeting a GCK gene.

Further, the present invention provides methods of decreasing plasma lactate levels in a subject having a disease or disorder that would benefit from a reduction in GCK expression, e.g., a GSD, e.g., type Ia GSD. The methods include administering an iRNA of the invention to the subject in a therapeutically effective amount of an iRNA targeting a GCK gene or a pharmaceutical composition comprising an iRNA targeting a GCK gene.

The present invention also provides methods of decreasing plasma uric acid levels in a subject having a disease or disorder that would benefit from a reduction in GCK expression, e.g., a GSD, e.g., type Ia GSD. The methods include administering an iRNA of the invention to the subject in a therapeutically effective amount of an iRNA targeting a GCK gene or a pharmaceutical composition comprising an iRNA targeting a GCK gene.

The present invention provides methods of decreasing plasma triglyceride levels in a subject having a disease or disorder that would benefit from a reduction in GCK expression, e.g., a GSD, e.g., type Ia GSD. The methods include administering an iRNA of the invention to the subject in a therapeutically effective amount of an iRNA targeting a GCK gene or a pharmaceutical composition comprising an iRNA targeting a GCK gene.

The present invention further provides methods of decreasing total plasma cholesterol levels in a subject having a disease or disorder that would benefit from a reduction in GCK expression, e.g., a GSD, e.g., type Ia GSD. The methods include administering an iRNA of the invention to the subject in a therapeutically effective amount of an iRNA targeting a GCK gene or a pharmaceutical composition comprising an iRNA targeting a GCK gene.

The present invention also provides methods of decreasing hepatomegaly in a subject having a disease or disorder that would benefit from a reduction in GCK expression, e.g., a GSD, e.g., type Ia GSD. The methods include administering an iRNA of the invention to the subject in a therapeutically effective amount of an iRNA targeting a GCK gene or a pharmaceutical composition comprising an iRNA targeting a GCK gene.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of GCK gene expression include those having a glycogen storage disease (GSD), e.g., type Ia GSD. In one embodiment, subjects that would benefit from a reduction and/or inhibition of GCK gene expression are those having one or more signs or symptoms associated with a glycogen storage disease (GSD), e.g., type Ia GSD, including, but not limited to, hypoglycemia, lactic acidosis, hyperuricemia, hyperlipidemia, hepatomegaly, kidney disease as a result of glycogen accumulation, hunger, jitteriness, lethargy, apnea, seizures, diaphoresis, confusion, headaches, dizziness, unusual mood or behavior changes, loss of consciousness, coma, muscle cramps, bleeding diathesis, short stature, osteoporosis, delayed puberty, gout, renal disease, systemic hypertension, pulmonary hypertension, hepatic adenomas, pancreatitis, anemia, vitamin D deficiency, polycystic ovaries, irregular menstrual cycles, menorrhagia, and eruptive xanthomata.

Treatment of a subject that would benefit from a reduction and/or inhibition of GCK gene expression and normalization of blood glucose levels includes therapeutic treatment (e.g., of a subject suffering from a glycogen storage disease (GSD)) and prophylactic treatment (e.g., of a subject that does not meet the diagnostic criteria of a glycogen storage disease (GSD), or a subject who may be at risk of developing a glycogen storage disease (GSD)).

The invention further provides methods for the use of an iRNA or a pharmaceutical composition thereof, e.g., for treating a subject that would benefit from reduction and/or inhibition of GCK expression, e.g., a subject having a glycogen storage disease (GSD), e.g., type Ia GSD, in combination with other pharmaceuticals and/or other therapeutic methods, e.g., with known pharmaceuticals and/or known therapeutic methods, such as, for example, those which are currently employed for treating these disorders. For example, in certain embodiments, an iRNA targeting GCK is administered to a subject having a GSD in combination with, e.g., antihypertensive agents, such as Diazoxide, somatostatin analogues, such as Octreotide, calcium channel blockers, such as, Nifedipine, Thiazide diuretics, such as chlorothiazide (e.g., in combination with Diazoxide), intravenous infusion of glucagon, parenterally administered dextrose; and/or partial pancreatectomy. In some embodiments, an iRNA targeting GCK is administered to a subject having type Ia GSD in combination with, e.g., a sodium-glucose co-transporter 2 (SGLT2) inhibitor, e.g., Dapagliflozin, Canagliflozin, Ipragliflozin (ASP-1941), Tofogliflozin, Empagliflozin, Sergliflozin etabonate, Remogliflozin etabonate (BHV091009), and Ertugliflozin (PF-04971729/MK-8835).

The iRNA and additional therapeutic agents may be administered at the same time and/or in the same combination, e.g., parenterally, or the additional therapeutic agent can be administered as part of a separate composition or at separate times and/or by another method known in the art or described herein.

In one embodiment, the method includes administering a composition featured herein such that expression of the target GCK gene is decreased, such as for about 1, 2, 3, 4, 5, 6, 7, 8, 12, 16, 18, 24 hours, 28, 32, or about 36 hours. In one embodiment, expression of the target GCK gene is decreased for an extended duration, e.g., at least about two, three, four days or more, e.g., about one week, two weeks, three weeks, or four weeks or longer.

Preferably, the iRNAs useful for the methods and compositions featured herein specifically target RNAs (primary or processed) of the target GCK gene. Compositions and methods for inhibiting the expression of these genes using iRNAs can be prepared and performed as described herein.

Administration of the dsRNA according to the methods of the invention may result in a reduction of the severity, signs, symptoms, and/or markers of such diseases or disorders in a patient with a glycogen storage disease (GSD), e.g., type Ia GSD. By "reduction" in this context is meant a statistically significant decrease in such level. The reduction can be, for example, at least about 20%, 25%, 30%, 35%, 40%, 45%, 50%, 55%, 60%, 65%, 70%, 75%, 80%, 85%, 90%, 95%, or 100%.

Efficacy of treatment or prevention of disease can be assessed, for example by measuring disease progression, disease remission, symptom severity, reduction in pain, quality of life, dose of a medication required to sustain a treatment effect, level of a disease marker, or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a glycogen storage disease (GSD) may be assessed, for example, by periodic monitoring of, e.g., blood glucose levels. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting GCK or pharmaceutical composition thereof, "effective against" a glycogen storage disease (GSD) indicates that administration in a clinically appropriate manner results in a beneficial effect for at least a statistically significant fraction of patients, such as a improvement of symptoms, a cure, a reduction in disease, extension of life, improvement in quality of life, or other effect generally recognized as positive by medical doctors familiar with treating a glycogen storage disease (GSD) and the related causes and effects.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale such as those provided above. Any positive change resulting in e.g., lessening of severity of disease measured using the appropriate scale, represents adequate treatment using an iRNA or iRNA formulation as described herein.

Subjects can be administered a therapeutic amount of dsRNA, such as about 0.01 mg/kg to about 200 mg/kg.

The iRNA can be administered by intravenous infusion over a period of time, on a regular basis. In certain embodiments, after an initial treatment regimen, the treatments can be administered on a less frequent basis. Administration of the iRNA can reduce GCK levels, e.g., in a cell, tissue, blood, urine, or other compartment of the patient by at least about 20, 21, 22, 23, 24, 25, 26, 27, 28, 29, 30, 31, 32, 33, 34, 35, 36, 37, 38, 39, 40, 41, 42, 43, 44, 45, 46, 47, 48, 39, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% or more.

Before administration of a full dose of the iRNA, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the iRNA can be administered subcutaneously, i.e., by subcutaneous injection. One or more injections may be used to deliver the desired daily dose of iRNA to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of iRNA on a regular basis, such as every other day or to once a year. In certain embodiments, the iRNA is administered about once per month to about once per quarter (i.e., about once every three months).

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. iRNA Design, Synthesis, Selection, and In Vitro Evaluation

This Example describes methods for the design, synthesis, selection, and in vitro evaluation of GCK iRNA agents.

Source of Reagents

Where the source of a reagent is not specifically given herein, such reagent can be obtained from any supplier of reagents for molecular biology at a quality/purity standard for application in molecular biology.

Bioinformatics

A set of siRNAs targeting the human GCK, "glucokinase (hexokinase 4)", (human: NCBI refseqID NM_033507; NCBI GeneID: 2645), as well as toxicology-species GCK orthologs (cynomolgus monkey: XM_005549685; mouse: NM_010292; rat, NM_012565) were designed using custom R and Python scripts. The human NM_033507 REFSEQ mRNA, version 1, has a length of 2442 bases. The rationale and method for the set of siRNA designs is as follows: the predicted efficacy for every potential 19mer iRNA from position 1 through position 2442 (the coding region and 3' UTR) was determined with a linear model derived the direct measure of mRNA knockdown from more than 20,000 distinct iRNA designs targeting a large number of vertebrate genes. Subsets of the GCK iRNAs were designed with perfect or near-perfect matches between human, cynomolgus and rhesus monkey. A further subset was designed with perfect or near-perfect matches to mouse and rat GCK orthologs. For each strand of the iRNA, a custom Python script was used in a brute force search to measure the number and positions of mismatches between the iRNA and all potential alignments in the target species transcriptome. Extra weight was given to mismatches in the seed region, defined here as positions 2-9 of the antisense oligonucleotide, as well the cleavage site of the iRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by assuming the value of each weighted mismatch. Preference was given to iRNAs whose antisense score in human and cynomolgus monkey was >=2.0 and predicted efficacy was >=50% knockdown of the GCK transcript.

Synthesis of GCK Sequences

Synthesis of GCK Single Strands and Duplexes

GCK siRNA sequences were synthesized at 1 umol scale on Mermade 192 synthesizer (BioAutomation) using the solid support mediated phosphoramidite chemistry. The solid support was controlled pore glass (500° A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, Wis.) and Hongene (China). 2'F, 2'-O-Methyl, RNA, DNA and other modified nucleosides were introduced in the sequences using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1, 2, 4-dithiazole-3-thione (DDTT, obtained from Chemgenes (Wilmington, Mass., USA) in anhydrous acetonitrile/pyridine (1:1 v/v). Oxidation time was 3 minutes. All sequences were synthesized with final removal of the DMT group ("DMT off").

Upon completion of the solid phase synthesis, single strands were cleaved from the solid support and deprotected in sealed 96 deep well plates using 200 μL Aqueous Methylamine reagent at 60° C. for 20 minutes. For sequences containing 2' ribo residues (2'-OH) that are protected with tert-butyl dimethyl silyl (TBDMS) group, a second step deprotection was performed using TEA.3HF (triethylamine trihydro fluoride) reagent. To the methylamine deprotection solution, 200 μL of dimethyl sulfoxide (DMSO) and 300 μl TEA.3HF reagent was added and the solution was incubated for additional 20 min at 60° C. At the end of cleavage and deprotection step, the synthesis plate was allowed to come to room temperature and was precipitated by addition of 1 mL of acetontile:ethanol mixture (9:1). The plates were cooled at −80° C. for 2 hrs and the supernatant decanted carefully with the aid of a multi-channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96 well plates. Samples from each sequence were analyzed by LC-MS to confirm the identity, UV (260 nm) for quantification and a selected set of samples by IEX chromatography to determine purity.

Annealing of GCK single strands was performed on a Tecan liquid handling robot. Equimolar mixture of sense and antisense single strands were combined and annealed in 96 well plates. After combining the complementary single strands, the 96 well plate was sealed tightly and heated in an oven at 100° C. for 10 minutes and allowed to come slowly to room temperature over a period 2-3 hours. The concentration of each duplex was normalized to 10 uM in 1×PBS and then submitted for in vitro screening assays.

Cell Culture and Transfections for Single Dose and Dose Response Studies

Primary mouse hepatocytes (PMH) (GIBCO) or Primary Cynomolgus monkey hepatocytes (PCH) (Celsis) were transfected by adding 4.9 μl of Opti-MEM plus 0.1 μl of Lipofectamine RNAiMax per well (Invitrogen, Carlsbad Calif. cat #13778-150) to 5 μl of siRNA duplexes per well into a 384-well plate and incubated at room temperature for 15 minutes. Forty μl of William's E Medium (Life Tech) containing about $5 \times 10^3$ cells were then added to the siRNA mixture. Cells were incubated for 24 hours prior to RNA purification. Single dose experiments were performed at 10 nM and 0.1 nM final duplex concentration.

Total RNA Isolation Using DYNABEADS mRNA Isolation Kit (Invitrogen, Part #: 610-12)

Total RNA was isolated using an automated protocol on a BioTek-EL406 platform using DYNABEADs (Invitrogen, cat #61012). Briefly, 50 μl of Lysis/Binding Buffer and 25 μl of lysis buffer containing 3 μl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μl Wash Buffer A and once with Wash Buffer B. Beads were then washed with 150 μl Elution Buffer, re-captured and supernatant removed.

cDNA Synthesis Using ABI High Capacity cDNA Reverse Transcription Kit (Applied Biosystems, Foster City, Calif., Cat #4368813)

Ten μl of a master mix containing 1 μl 10× Buffer, 0.4 μl 25× dNTPs, 1 μl 10× Random primers, 0.5 μl Reverse Transcriptase, 0.5 μl RNase inhibitor and 6.6 μl of $H_2O$ per reaction was added to the RNA isolated as described above. Plates were sealed, mixed, and incubated on an electromagnetic shaker for 10 minutes at room temperature, followed by 2 h 37° C. Plates were then incubated at 80° C. for 8 minutes.

Real Time PCR

Two µl of cDNA was added to a master mix containing 0.5 µl GAPDH TaqMan Probe (Applied Biosystems Cat #4326317E), or 0.5 µl of Custom made Cyno GAPDH Taqman Probe, 0.5 µl GCK mouse probe (Mm00439129 ml) or 0.5 µl cyno probe (Mf02827184 ml) and 5 µl Lightcycler 480 probe master mix (Roche Cat #04887301001) per well in a 384 well plate (Roche cat #04887301001). Real time PCR is done in an Roche Lightcycler Real Time PCR system (Roche) using the ΔΔCt(RQ) assay. Each duplex was tested in two independent transfections.

To calculate relative fold change, real time data are analyzed using the ΔΔCt method and normalized to assays performed with cells transfected with a non-targeting control siRNA, AD-1955

The sense and antisense sequences of AD-1955 are:

```
SENSE:
                                    (SEQ ID NO: 29)
cuuAcGcuGAGuAcuucGAdTsdT ANTISENSE:
                                    (SEQ ID NO: 30)
UCGAAGuACUcAGCGuAAGdTsdT
```

TABLE 1

Abbreviations of nucleotide monomers used in nucleic acid sequence representation.
It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |

TABLE 1-continued

Abbreviations of nucleotide monomers used in nucleic acid sequence representation.
It will be understood that these monomers, when present in an oligonucleotide, are mutually linked by 5'-3'-phosphodiester bonds.

| Abbreviation | Nucleotide(s) |
| --- | --- |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| dT | 2'-deoxythymidine-3'-phosphate |
| dC | 2'-deoxycytidine-3'-phosphate |

A detailed list of the unmodified GCK sense and antisense strand sequences is shown in Table 2 and a detailed list of the modified GCK sense and antisense strand sequences is shown in Table 3.

Table 4 shows the results of a single dose screen in primary mouse hepatocytes transfected with the indicated modified siRNAs. Data are expressed as percent of message remaining relative to cells treated with a non-targeting control siRNA.

Table 5 shows the results of a single dose screen in primary Cynomologous hepatocytes transfected with the indicated modified siRNAs. Data are expressed as percent of message remaining relative to cells treated with a non-targeting control siRNA.

TABLE 2

| GCK Unmodified Sequences | | | | |
| --- | --- | --- | --- | --- |
| Duplex ID | Sense ID | Sense Sequence (5'-3') | SEQ ID NO: Postion in NM_033507.1 | Antisense ID |
| AD-69366 | A-139669 | GAGGACCUGAAGAAGGUGAUA | 31 _253-273_s | A-139670 |
| AD-69368 | A-139673 | GGACCUGAAGAAGGUGAUGAA | 32 _255-275_s | A-139674 |
| AD-69411 | A-139758 | GGACCUGAAGAAGGUGAUA | 33 _257-277_s | A-139759 |
| AD-69413 | A-139762 | ACCUGAAGAAGGUGAUGAA | 34 _259-279_s | A-139763 |
| AD-69367 | A-139671 | GGUGAUGAGACGGAUGCAGAA | 35 _267-287_s | A-139672 |
| AD-69369 | A-139675 | UGAUGAGACGGAUGCAGAAGA | 36 _269-289_s | A-139676 |
| AD-69412 | A-139760 | UGAUGAGACGGAUGCAGAA | 37 _271-291_s | A-139761 |

TABLE 2-continued

GCK Unmodified Sequences

| | | | | |
|---|---|---|---|---|
| AD-69414 | A-139764 | AUGAGACGGAUGCAGAAGA | 38_273-293_s | A-139765 |
| AD-69371 | A-139679 | ACGGAUGCAGAAGGAGAUGGA | 39_276-296_s | A-139680 |
| AD-69416 | A-139768 | GGAUGCAGAAGGAGAUGGA | 40_280-300_s | A-139769 |
| AD-69370 | A-139677 | ACCCAUGAAGAGGCCAGUGUA | 41_316-336_s | A-139678 |
| AD-69415 | A-139766 | CCAUGAAGAGGCCAGUGUA | 42_320-340_s | A-139767 |
| AD-69372 | A-139681 | CAGUGUGAAGAUGCUGCCCAA | 43_330-350_s | A-139682 |
| AD-69417 | A-139770 | GUGUGAAGAUGCUGCCCAA | 44_334-354_s | A-139771 |
| AD-69373 | A-139683 | GUGAAGGUGGGAGAAGGUGAA | 45_436-456_s | A-139684 |
| AD-69418 | A-139772 | GAAGGUGGGAGAAGGUGA | 46_440-460_s | A-139773 |
| AD-69374 | A-139685 | GAGCGUGAAGACCAAACACCA | 47_468-488_s | A-139686 |
| AD-69419 | A-139774 | GCGUGAAGACCAAACACCA | 48_472-492_s | A-139775 |
| AD-69375 | A-139687 | GAAGACCAAACACCAGAUGUA | 49_474-494_s | A-139688 |
| AD-69420 | A-139776 | AGACCAAACACCAGAUGUA | 50_478-498_s | A-139777 |
| AD-69376 | A-139689 | GACUUCCUGGACAAGCAUCAA | 51_565-585_s | A-139690 |
| AD-69377 | A-139691 | CUUCCUGGACAAGCAUCAGAU | 52_567-587_s | A-139692 |
| AD-69421 | A-139778 | CUUCCUGGACAAGCAUCAA | 53_569-589_s | A-139779 |
| AD-69422 | A-139780 | UCCUGGACAAGCAUCAGAU | 54_571-591_s | A-139781 |
| AD-69378 | A-139693 | CCUGGACAAGCAUCAGAUGAA | 55_570-590_s | A-139694 |
| AD-69379 | A-139695 | CUGGACAAGCAUCAGAUGAAA | 56_571-591_s | A-139696 |
| AD-69423 | A-139782 | UGGACAAGCAUCAGAUGAA | 57_574_594_s | A-139783 |
| AD-69424 | A-139784 | GGACAAGCAUCAGAUGAAA | 58_575-595_s | A-139785 |
| AD-69381 | A-139699 | AGGCACGAAGACAUCGAUAAA | 59_634-654_s | A-139700 |
| AD-69426 | A-139788 | GCACGAAGACAUCGAUAAA | 60_638-658_s | A-139789 |
| AD-69382 | A-139701 | ACAUCGAUAAGGGCAUCCUUA | 61_644-664_s | A-139702 |
| AD-69427 | A-139790 | AUCGAUAAGGGCAUCCUUA | 62_648-668_s | A-139791 |
| AD-69383 | A-139703 | CUGGACCAAGGGCUUCAAGGA | 63_669-689_s | A-139704 |
| AD-69428 | A-139792 | GGACCAAGGGCUUCAAGGA | 64_673-693_s | A-139793 |
| AD-69384 | A-139705 | GGGCUUCAAGGCCUCAGGAGA | 65_678-698_s | A-139706 |
| AD-69429 | A-139794 | GCUUCAAGGCCUCAGGAGA | 66_682-702_s | A-139795 |
| AD-69385 | A-139707 | CAGGAGCAGAAGGGAACAAUA | 67_692-712_s | A-139708 |
| AD-69386 | A-139709 | GGAGCAGAAGGGAACAAUGUA | 68_694-714_s | A-139710 |

TABLE 2-continued

GCK Unmodified Sequences

| AD-69430 | A-139796 | GGAGCAGAAGGGAACAAUA | 69 _696-716_s | A-139797 |
| --- | --- | --- | --- | --- |
| AD-69387 | A-139711 | GAGCAGAAGGGAACAAUGUCA | 70 _695-715_s | A-139712 |
| AD-69431 | A-139798 | AGCAGAAGGGAACAAUGUA | 71 _698-718_s | A-139799 |
| AD-69432 | A-139800 | GCAGAAGGGAACAAUGUCA | 72 _699-719_s | A-139801 |
| AD-69388 | A-139713 | GACUUUGAAAUGGAUGUGGUA | 73 _751-771_s | A-139714 |
| AD-69389 | A-139715 | CUUUGAAAUGGAUGUGGUGGA | 74 _753-773_s | A-139716 |
| AD-69433 | A-139802 | CUUUGAAAUGGAUGUGGUA | 75 _755-775_s | A-139803 |
| AD-69434 | A-139804 | UUGAAAUGGAUGUGGUGGA | 76 _757-777_s | A-139805 |
| AD-69391 | A-139719 | UGAAAUGGAUGUGGUGGCAAU | 77 _756-776_s | A-139720 |
| AD-69436 | A-139808 | AAAUGGAUGUGGUGGCAAU | 78 _760-780_s | A-139809 |
| AD-69392 | A-139721 | AUGGAUGUGGUGGCAAUGUA | 79 _760-780_s | A-139722 |
| AD-69402 | A-139721 | AUGGAUGUGGUGGCAAUGUA | 80 _760-780_s | A-139741 |
| AD-69393 | A-139723 | GGAUGUGGUGGCAAUGGUGAA | 81 _762-782_s | A-139724 |
| AD-69437 | A-139810 | GGAUGUGGUGGCAAUGGUA | 82 _764-784_s | A-139811 |
| AD-69438 | A-139812 | AUGUGGUGGCAAUGGUGAA | 83 _766-786_s | A-139813 |
| AD-69395 | A-139727 | GCAAUGGUGAAUGACACGGUA | 84 _772-792_s | A-139728 |
| AD-69440 | A-139816 | AAUGGUGAAUGACACGGUA | 85 _776-796_s | A-139817 |
| AD-69396 | A-139729 | CAGUGCGAGGUCGGCAUGAUA | 86 _826-846_s | A-139730 |
| AD-69441 | A-139818 | GUGCGAGGUCGGCAUGAUA | 87 _830-850_s | A-139819 |
| AD-69397 | A-139731 | ACAUGGAGGAGAUGCAGAAUA | 88 _872-892_s | A-139732 |
| AD-69442 | A-139820 | AUGGAGGAGAUGCAGAAUA | 89 _876-896_s | A-139821 |
| AD-69394 | A-139725 | GAUGCAGAAAUGUGGAGCUGGU | 90 _882-902_s | A-139726 |
| AD-69439 | A-139814 | UGCAGAAUGUGGAGCUGGU | 91 _886-906_s | A-139815 |
| AD-69398 | A-139733 | GUGGACGAGAGCUCUGCAAAA | 92 _1000-1020_s | A-139734 |
| AD-69443 | A-139822 | GGACGAGAGCUCUGCAAAA | 93 _1004-1024_s | A-139823 |
| AD-69380 | A-139697 | AAGUACAUGGGCGAGCUGGUA | 94 _1057-1077_s | A-139698 |
| AD-69425 | A-139786 | GUACAUGGGCGAGCUGGUA | 95 _1061-1081_s | A-139787 |
| AD-69403 | A-139742 | AGGCUCGUGGACGAAAACCUA | 96 _1093-1113_s | A-139743 |
| AD-69447 | A-139830 | GCUCGUGGACGAAAACCUA | 97 _1097-1117_s | A-139831 |
| AD-69404 | A-139744 | CGUGGACGAAAACCUGCUCUU | 98 _1098-1118_s | A-139745 |
| AD-69405 | A-139746 | GUGGACGAAAACCUGCUCUUA | 99 _1099-1119_s | A-139747 |

TABLE 2-continued

| GCK Unmodified Sequences | | | | |
|---|---|---|---|---|
| AD-69448 | A-139832 | UGGACGAAAACCUGCUCUU | 100_1102-1122_s | A-139833 |
| AD-69449 | A-139834 | GGACGAAAACCUGCUCUUA | 101_1103-1123_s | A-139835 |
| AD-69406 | A-139748 | CGCAAGCAGAUCUACAACAUA | 102_1204-1224_s | A-139749 |
| AD-69450 | A-139836 | CAAGCAGAUCUACAACAUA | 103_1208-1228_s | A-139837 |
| AD-69390 | A-139717 | AGCUGCGAGAUCACCUUCAUA | 104_1468-1488_s | A-139718 |
| AD-69435 | A-139806 | CUGCGAGAUCACCUUCAUA | 105_1472-1492_s | A-139807 |
| AD-69408 | A-139752 | CCAGUCCUGGCCAUUUUCUUA | 106_2049-2069_s | A-139753 |
| AD-69452 | A-139840 | AGUCCUGGCCAUUUUCUUA | 107_2053-2073_s | A-139841 |
| AD-69409 | A-139754 | CACUGAGUGGCUUGUGAUUCU | 108_2170-2190_s | A-139755 |
| AD-69453 | A-139842 | CUGAGUGGCUUGUGAUUCU | 109_2174-2194_s | A-139843 |
| AD-69410 | A-139756 | AAUGUUAAAAGUUUUAAACAU | 110_2413-2433_s | A-139757 |
| AD-69454 | A-139844 | UGUUAAAAGUUUUAAACAU | 111_2417-2437_s | A-139845 |
| AD-69444 | A-139824 | AGCAGAAGGGAACAACAUA | 112_698-718_s | A-139825 |
| AD-69399 | A-139735 | GGAGCAGAAGGGAACAACAUA | 113_694-714_s | A-139736 |
| AD-69445 | A-139826 | UCUCCGAGAUGCUAUCAAA | 114_725-745_s | A-139827 |
| AD-69400 | A-139737 | CUUCUCCGAGAUGCUAUCAAA | 115_721-741_s | A-139738 |
| AD-69446 | A-139828 | AGAUGGAUGUGGUGGCAAU | 116_760-780_s | A-139829 |
| AD-69401 | A-139739 | UGAGAUGGAUGUGGUGGCAAU | 117_756-776_s | A-139740 |
| AD-69451 | A-139838 | CUGCGAAAUCACCUUCAUU | 118_1472-1492_s | A-139839 |
| AD-69407 | A-139750 | AACUGCGAAAUCACCUUCAUU | 119_1468-1488_s | A-139751 |

| Duplex ID | Antisense Sequence (5'-3') | SEQ ID Postion in NO:NM_033507.1 | cross_sp |
|---|---|---|---|
| AD-69366 | UAUCACCUUCUUCAGGUCCUCCU | 120_251-273_as | hcmr |
| AD-69368 | UUCAUCACCUUCUUCAGGUCCUC | 121_253-275_as | hcmr |
| AD-69411 | UAUCACCUUCUUCAGGUCC | 122_255-277_as | hcmr |
| AD-69413 | UUCAUCACCUUCUUCAGGU | 123_257-279_as | hcmr |
| AD-69367 | UUCUGCAUCCGUCUCAUCACCUU | 124_265-287_as | hcmr |
| AD-69369 | UCUUCUGCAUCCGUCUCAUCACC | 125_267-289_as | hcmr |
| AD-69412 | UUCUGCAUCCGUCUCAUCA | 126_269-291_as | hcmr |
| AD-69414 | UCUUCUGCAUCCGUCUCAU | 127_271-293_as | hcmr |
| AD-69371 | UCCAUCUCCUUCUGCAUCCGUCU | 128_274-296_as | hcmr |
| AD-69416 | UCCAUCUCCUUCUGCAUCC | 129_278-300_as | hcmr |

TABLE 2-continued

GCK Unmodified Sequences

| AD-69370 | UACACUGGCCUCUUCAUGGGUCU | 130_314-336_as | hcmr |
| AD-69415 | UACACUGGCCUCUUCAUGG | 131_318-340_as | hcmr |
| AD-69372 | UUGGGCAGCAUCUUCACACUGGC | 132_328-350_as | hc |
| AD-69417 | UUGGGCAGCAUCUUCACAC | 133_332-354_as | hc |
| AD-69373 | UUCACCUUCUCCCACCUUCACCA | 134_434-456_as | hc |
| AD-69418 | UUCACCUUCUCCCACCUUC | 135_438-460_as | hc |
| AD-69374 | UGGUGUUUGGUCUUCACGCUCCA | 136_466-488_as | hc |
| AD-69419 | UGGUGUUUGGUCUUCACGC | 137_470-492_as | hc |
| AD-69375 | UACAUCUGGUGUUUGGUCUUCAC | 138_472-494_as | hcmr |
| AD-69420 | UACAUCUGGUGUUUGGUCU | 139_476-498_as | hcmr |
| AD-69376 | UUGAUGCUUGUCCAGGAAGUCGG | 140_563-585_as | hcmr |
| AD-69377 | AUCUGAUGCUUGUCCAGGAAGUC | 141_565-587_as | hcmr |
| AD-69421 | UUGAUGCUUGUCCAGGAAG | 142_567-589_as | hcmr |
| AD-69422 | AUCUGAUGCUUGUCCAGGA | 143_569-591_as | hcmr |
| AD-69378 | UUCAUCUGAUGCUUGUCCAGGAA | 144_568-590_as | hcmr |
| AD-69379 | UUUCAUCUGAUGCUUGUCCAGGA | 145_569-591_as | hcmr |
| AD-69423 | UUCAUCUGAUGCUUGUCCA | 146_572-594_as | hcmr |
| AD-69424 | UUUCAUCUGAUGCUUGUCC | 147_573-595_as | hcmr |
| AD-69381 | UUUAUCGAUGUCUUCGUGCCUCA | 148_632-654_as | hc |
| AD-69426 | UUUAUCGAUGUCUUCGUGC | 149_636-658_as | hc |
| AD-69382 | UAAGGAUGCCCUUAUCGAUGUCU | 150_642-664_as | hc |
| AD-69427 | UAAGGAUGCCCUUAUCGAU | 151_646-668_as | hc |
| AD-69383 | UCCUUGAAGCCCUUGGUCCAGUU | 152_667-689_as | hcmr |
| AD-69428 | UCCUUGAAGCCCUUGGUCC | 153_671-693_as | hcmr |
| AD-69384 | UCUCCUGAGGCCUUGAAGCCCUU | 154_676-698_as | hc |
| AD-69429 | UCUCCUGAGGCCUUGAAGC | 155_680-702_as | hc |
| AD-69385 | UAUUGUUCCCUUCUGCUCCUGAG | 156_690-712_as | hc |
| AD-69386 | UACAUUGUUCCCUUCUGCUCCUG | 157_692-714_as | hc |
| AD-69430 | UAUUGUUCCCUUCUGCUCC | 158_694-716_as | hc |
| AD-69387 | UGACAUUGUUCCCUUCUGCUCCU | 159_693-715_as | hc |
| AD-69431 | UACAUUGUUCCCUUCUGCU | 160_696-718_as | hc |

TABLE 2-continued

| GCK Unmodified Sequences | | | |
|---|---|---|---|
| AD-69432 | UGACAUUGUUCCCUUCUGC | 161_697-719_as | hc |
| AD-69388 | UACCACAUCCAUUUCAAAGUCCC | 162_749-771_as | hcmr |
| AD-69389 | UCCACCACAUCCAUUUCAAAGUC | 163_751-773_as | hcmr |
| AD-69433 | UACCACAUCCAUUUCAAAG | 164_753-775_as | hcmr |
| AD-69434 | UCCACCACAUCCAUUUCAA | 165_755-777_as | hcmr |
| AD-69391 | AUUGCCACCACAUCCAUUUCAAA | 166_754-776_as | hcmr |
| AD-69436 | AUUGCCACCACAUCCAUUU | 167_758-780_as | hcmr |
| AD-69392 | UACCAUUGCCACCACAUCCAUUU | 168_758-780_as | hcmr |
| AD-69402 | UACCAUUGCCACCACAUCCAUCU | 169_758-780_as | mr |
| AD-69393 | UUCACCAUUGCCACCACAUCCAU | 170_760-782_as | hcmr |
| AD-69437 | UACCAUUGCCACCACAUCC | 171_762-784_as | hcmr |
| AD-69438 | UUCACCAUUGCCACCACAU | 172_764-786_as | hcmr |
| AD-69395 | UACCGUGUCAUUCACCAUUGCCA | 173_770-792_as | hc |
| AD-69440 | UACCGUGUCAUUCACCAUU | 174_774-796_as | hc |
| AD-69396 | UAUCAUGCCGACCUCGCACUGAU | 175_824-846_as | hcmr |
| AD-69441 | UAUCAUGCCGACCUCGCAC | 176_828-850_as | hcmr |
| AD-69397 | UAUUCUGCAUCUCCUCCAUGUAG | 177_870-892_as | hc |
| AD-69442 | UAUUCUGCAUCUCCUCCAU | 178_874-896_as | hc |
| AD-69394 | ACCAGCUCCACAUUCUGCAUCUC | 179_880-902_as | hcmr |
| AD-69439 | ACCAGCUCCACAUUCUGCA | 180_884-906_as | hcmr |
| AD-69398 | UUUUGCAGAGCUCUCGUCCACCA | 181_998-1020_as | hc |
| AD-69443 | UUUUGCAGAGCUCUCGUCC | 182_1002-1024_as | hc |
| AD-69380 | UACCAGCUCGCCCAUGUACUUGC | 183_1055-1077_as | hcmr |
| AD-69425 | UACCAGCUCGCCCAUGUAC | 184_1059-1081_as | hcmr |
| AD-69403 | UAGGUUUUCGUCCACGAGCCUGA | 185_1091-1113_as | hc |
| AD-69447 | UAGGUUUUCGUCCACGAGC | 186_1095-1117_as | hc |
| AD-69404 | AAGAGCAGGUUUUCGUCCACGAG | 187_1096-1118_as | hc |
| AD-69405 | UAAGAGCAGGUUUUCGUCCACGA | 188_1097-1119_as | hc |
| AD-69448 | AAGAGCAGGUUUUCGUCCA | 189_1100-1122_as | hc |
| AD-69449 | UAAGAGCAGGUUUUCGUCC | 190_1101-1123_as | hc |
| AD-69406 | UAUGUUGUAGAUCUGCUUGCGGU | 191_1202-1224_as | hc |

TABLE 2-continued

GCK Unmodified Sequences

| | | | |
|---|---|---|---|
| AD-69450 | UAUGUUGUAGAUCUGCUUG | 192_1206-1228_as | hc |
| AD-69390 | UAUGAAGGUGAUCUCGCAGCUGG | 193_1466-1488_as | hcmr |
| AD-69435 | UAUGAAGGUGAUCUCGCAG | 194_1470-1492_as | hcmr |
| AD-69408 | UAAGAAAAUGGCCAGGACUGGGU | 195_2047-2069_as | hc |
| AD-69452 | UAAGAAAAUGGCCAGGACU | 196_2051-2073_as | hc |
| AD-69409 | AGAAUCACAAGCCACUCAGUGAU | 197_2168-2190_as | hc |
| AD-69453 | AGAAUCACAAGCCACUCAG | 198_2172-2194_as | hc |
| AD-69410 | AUGUUUAAAACUUUUAACAUUUU | 199_2411-2433_as | hc |
| AD-69454 | AUGUUUAAAACUUUUAACA | 200_2415-2437_as | hc |
| AD-69444 | UAUGUUGUUCCCUUCUGCU | 201_696-718_as | mr |
| AD-69399 | UAUGUUGUUCCCUUCUGCUCGG | 202_692-714_as | mr |
| AD-69445 | UUUGAUAGCAUCUCGGAGA | 203_723-745_as | mr |
| AD-69400 | UUUGAUAGCAUCUCGGAGAAGUC | 204_719-741_as | mr |
| AD-69446 | AUUGCCACCACAUCCAUCU | 205_758-780_as | mr |
| AD-69401 | AUUGCCACCACAUCCAUCUAAA | 206_754-776_as | mr |
| AD-69451 | AAUGAAGGUGAUUUCGCAG | 207_1470-1492_as | mr |
| AD-69407 | AAUGAAGGUGAUUUCGCAGUUGG | 208_1466-1488_as | mr |

TABLE 3

GCK Modified Sequences

| Duplex ID | Sense ID | Sense sequence (5'-3') | SEQ ID NO: | Anti-sense ID | Antisense sequence (5'-3') | SEQ ID NO: | mRNA sequence | SEQ ID NO: |
|---|---|---|---|---|---|---|---|---|
| AD-69366 | A-139669 | gsasggacCfuGfAfAfgaaggugauaL96 | 209 | A-139670 | usAfsucaCfcUfUfcuucAfgGfuccucscsu | 298 | AGGAGGACCUGAAGAAGGUGAUA | 387 |
| AD-69368 | A-139673 | gsgsaccuGfaAfGfAfaggugaugaaL96 | 210 | A-139674 | usUfscauCfaCfCfuucuUfcAfgguccsusc | 299 | GAGGACCUGAAGAAGGUGAUGAA | 388 |
| AD-69411 | A-139758 | GGACCUGAAGAAGGUGAUAdTdT | 211 | A-139759 | UAUCACCUUCUUCAGGUCCdTdT | 300 | GGACCUGAAGAAGGUGAUA | 389 |
| AD-69413 | A-139762 | ACCUGAAGAAGGUGAUGAAdTdT | 212 | A-139763 | UUCAUCACCUUCUUCAGGUdTdT | 301 | ACCUGAAGAAGGUGAUGAA | 390 |
| AD-69367 | A-139671 | gsgsugauGfaGfAfCfggaugcagaaL96 | 213 | A-139672 | usUfscugCfaUfCfcgucUfcAfucaccsusu | 302 | AAGGUGAUGAGACGGAUGCAGAA | 391 |
| AD-69369 | A-139675 | usgsaugaGfaCfGfGfaugcagaagaL96 | 214 | A-139676 | usCfsuucUfgCfAfuccgUfcUfcaucascsc | 303 | GGUGAUGAGACGGAUGCAGAAGA | 392 |
| AD-69412 | A-139760 | UGAUGAGACGGAUGCAGAAdTdT | 215 | A-139761 | UUCUGCAUCCGUCUCAUCAdTdT | 304 | UGAUGAGACGGAUGCAGAA | 393 |
| AD-69414 | A-139764 | AUGAGACGGAUGCAGAAGAdTdT | 216 | A-139765 | UCUUCUGCAUCCGUCUCAUdTdT | 305 | AUGAGACGGAUGCAGAAGA | 394 |

TABLE 3-continued

GCK Modified Sequences

| Duplex ID | Sense ID | Sense sequence (5'-3') | SEQ ID NO: | Anti-sense ID | Antisense sequence (5'-3') | SEQ ID NO: | mRNA sequence | SEQ ID NO: |
|---|---|---|---|---|---|---|---|---|
| AD-69371 | A-139679 | ascsggauGfcAfGfAfaggagauggaL96 | 217 | A-139680 | usCfscauCfuCfCfuucuGfcAfuccgususu | 306 | AGACGGAUGCAGAAGGAGAUGGA | 395 |
| AD-69416 | A-139768 | GGAUGCAGAAGGAGAUGGAdTdT | 218 | A-139769 | UCCAUCUCCUUCUGCAUCCdTdT | 307 | GGAUGCAGAAGGAGAUGGA | 396 |
| AD-69370 | A-139677 | ascsccauGfaAfGfAfggccaguguaL96 | 219 | A-139678 | usAfscacUfgGfCfcucuUfcAfuggguscsu | 308 | AGACCCAUGAAGAGGCCAGUGUA | 397 |
| AD-69415 | A-139766 | CCAUGAAGAGGCCAGUGUAdTdT | 220 | A-139767 | UACACUGGCCUCUUCAUGGdTdT | 309 | CCAUGAAGAGGCCAGUGUA | 398 |
| AD-69372 | A-139681 | csasguguGfaAfGfAfugcugccaaL96 | 221 | A-139682 | usUfsgggCfaGfCfaucuUfcAfcacugsgsc | 310 | GCCAGUGUGAAGAUGCUGCCCAA | 399 |
| AD-69417 | A-139770 | GUGUGAAGAUGCUGCCCAAdTdT | 222 | A-139771 | UUGGGCAGCAUCUUCACACdTdT | 311 | GUGUGAAGAUGCUGCCCAA | 400 |
| AD-69373 | A-139683 | gsusgaagGfuGfGfGfagaagguGaaL96 | 223 | A-139684 | usUfscacCfuUfCfucccAfcCfuucacscsa | 312 | UGGUGAAGGUGGGAGAAGGUGAA | 401 |
| AD-69418 | A-139772 | GAAGGUGGGAGAAGGUGAAdTdT | 224 | A-139773 | UUCACCUUCUCCCACCUUCdTdT | 313 | GAAGGUGGGAGAAGGUGAA | 402 |
| AD-69374 | A-139685 | gsasgcguGfaAfGfAfccaaacaccaL96 | 225 | A-139686 | usGfsgugUfuUfGfgucuUfcAfcgcucscsa | 314 | UGGAGCGUGAAGACCAAACACCA | 403 |
| AD-69419 | A-139774 | GCGUGAAGACCAAACACCAdTdT | 226 | A-139775 | UGGUGUUUGGUCUUCACGCdTdT | 315 | GCGUGAAGACCAAACACCA | 404 |
| AD-69375 | A-139687 | gsasagacCfaAfAfCfaccagauguaL96 | 227 | A-139688 | usAfscauCfuGfGfuguuUfgGfucuucsasc | 316 | GUGAAGACCAAACACCAGAUGUA | 405 |
| AD-69420 | A-139776 | AGACCAAACACCAGAUGUAdTdT | 228 | A-139777 | UACAUCUGGUGUUUGGUCUdTdT | 317 | AGACCAAACACCAGAUGUA | 406 |
| AD-69376 | A-139689 | gsascuucCfuGfGfAfcaagcaucaaL96 | 229 | A-139690 | usUfsgauGfcUfUfguccAfgGfaagucsgsg | 318 | CCGACUUCCUGGACAAGCAUCAA | 407 |
| AD-69377 | A-139691 | csusuccuGfgAfCfAfagcaucagauL96 | 230 | A-139692 | asUfscugAfuGfCfuuguCfcAfggaagsusc | 319 | GACUUCCUGGACAAGCAUCAGAU | 408 |
| AD-69421 | A-139778 | CUUCCUGGACAAGCAUCAAdTdT | 231 | A-139779 | UUGAUGCUUGUCCAGGAAGdTdT | 320 | CUUCCUGGACAAGCAUCAA | 409 |
| AD-69422 | A-139780 | UCCUGGACAAGCAUCAGAUdTdT | 232 | A-139781 | AUCUGAUGCUUGUCCAGGAdTdT | 321 | UCCUGGACAAGCAUCAGAU | 410 |
| AD-69378 | A-139693 | cscsuggaCfaAfGfCfaucagaugaaL96 | 233 | A-139694 | usUfscauCfuGfAfugcuUfgUfccaggsasa | 322 | UUCCUGGACAAGCAUCAGAUGAA | 411 |
| AD-69379 | A-139695 | csusggacAfaGfCfAfucagaugaaaL96 | 234 | A-139696 | usUfsucaUfcUfGfaugcUfuGfuccagsgsa | 323 | UCCUGGACAAGCAUCAGAUGAAA | 412 |
| AD-69423 | A-139782 | UGGACAAGCAUCAGAUGAAdTdT | 235 | A-139783 | UUCAUCUGAUGCUUGUCCAdTdT | 324 | UGGACAAGCAUCAGAUGAA | 413 |
| AD-69424 | A-139784 | GGACAAGCAUCAGAUGAAAdTdT | 236 | A-139785 | UUUCAUCUGAUGCUUGUCCdTdT | 325 | GGACAAGCAUCAGAUGAAA | 414 |
| AD-69381 | A-139699 | asgsgcacGfaAfGfAfcaucgauaaaL96 | 237 | A-139700 | usUfsuauCfgAfUfgucuUfcGfugccuscsa | 326 | UGAGGCACGAAGACAUCGAUAAA | 415 |
| AD-69426 | A-139788 | GCACGAAGACAUCGAUAAAdTdT | 238 | A-139789 | UUUAUCGAUGUCUUCGUGCdTdT | 327 | GCACGAAGACAUCGAUAAA | 416 |
| AD-69382 | A-139701 | ascsaucgAfuAfAfGfggcauccuuaL96 | 239 | A-139702 | usAfsaggAfuGfCfccuuAfuCfgaugscsu | 328 | AGACAUCGAUAAGGGCAUCCUUA | 417 |
| AD-69427 | A-139790 | AUCGAUAAGGGCAUCCUUAdTdT | 240 | A-139791 | UAAGGAUGCCCUUAUCGAUdTdT | 329 | AUCGAUAAGGGCAUCCUUA | 418 |
| AD-69383 | A-139703 | csusggacCfaAfGfGfgcuucaaggaL96 | 241 | A-139704 | usCfscuuGfaAfGfcccuUfgGfuccagsusu | 330 | AACUGGACCAAGGGCUUCAAGGA | 419 |

TABLE 3-continued

GCK Modified Sequences

| Duplex ID | Sense ID | Sense sequence (5'-3') | SEQ ID NO: | Anti-sense ID | Antisense sequence (5'-3') | SEQ ID NO: | mRNA sequence | SEQ ID NO: |
|---|---|---|---|---|---|---|---|---|
| AD-69428 | A-139792 | GGACCAAGGGCUUCAA GGAdTdT | 242 | A-139793 | UCCUUGAAGCCCUUGG UCCdTdT | 331 | GGACCAAGGGCUUCAA GGA | 420 |
| AD-69384 | A-139705 | gsgsgcuuCfaAfGfGfccucagg agaL96 | 243 | A-139706 | usCfsuccUfgAfGfgccuUfgA fagcccsusu | 332 | AAGGGCUUCAAGGCCU CAGGAGA | 421 |
| AD-69429 | A-139794 | GCUUCAAGGCCUCAGG AGAdTdT | 244 | A-139795 | UCUCCUGAGGCCUUGA AGCdTdT | 333 | GCUUCAAGGCCUCAGG AGA | 422 |
| AD-69385 | A-139707 | csasggagCfaGfAfAfgggaaca auaL96 | 245 | A-139708 | usAfsuugUfuCfCfcuucUfgC fuccugsasg | 334 | CUCAGGAGCAGAAGGG AACAAUA | 423 |
| AD-69386 | A-139709 | gsgsagcaGfaAfGfGfgaacaau guaL96 | 246 | A-139710 | usAfscauUfgUfUfcccuUfcU fgcuccsusg | 335 | CAGGAGCAGAAGGGAA CAAUGUA | 424 |
| AD-69430 | A-139796 | GGAGCAGAAGGGAACA AUAdTdT | 247 | A-139797 | UAUUGUUCCCUUCUGC UCCdTdT | 336 | GGAGCAGAAGGGAACA AUA | 425 |
| AD-69387 | A-139711 | gsasgcagAfaGfGfGfaacaaug ucaL96 | 248 | A-139712 | usGfsacaUfuGfUfucccUfuCf ugcucscsu | 337 | AGGAGCAGAAGGGAAC AAUGUCA | 426 |
| AD-69431 | A-139798 | AGCAGAAGGGAACAAU GUAdTdT | 249 | A-139799 | UACAUUGUUCCCUUCU GCUdTdT | 338 | AGCAGAAGGGAACAAU GUA | 427 |
| AD-69432 | A-139800 | GCAGAAGGGAACAAUG UCAdTdT | 250 | A-139801 | UGACAUUGUUCCCUUC UGCdTdT | 339 | GCAGAAGGGAACAAUG UCA | 428 |
| AD-69388 | A-139713 | gsascuuuGfaAfAfUfggaugug guaL96 | 251 | A-139714 | usAfsccaCfaUfCfcauuUfcAf aagucscsc | 340 | GGGACUUUGAAAUGGA UGUGGUA | 429 |
| AD-69389 | A-139715 | csusuugaAfaUfGfGfauguggu ggaL96 | 252 | A-139716 | usCfscacCfaCfAfuccaUfuUf caaagsusc | 341 | GACUUUGAAAUGGAUG UGGUGGA | 430 |
| AD-69433 | A-139802 | CUUUGAAAUGGAUGUG GUAdTdT | 253 | A-139803 | UACCACAUCCAUUUCA AAGdTdT | 342 | CUUUGAAAUGGAUGUG GUA | 431 |
| AD-69434 | A-139804 | UUGAAAUGGAUGUGGU GGAdTdT | 254 | A-139805 | UCCACCACAUCCAUUU CAAdTdT | 343 | UUGAAAUGGAUGUGGU GGA | 432 |
| AD-69391 | A-139719 | usgsaaauGfgAfUfGfuggugc aauL96 | 255 | A-139720 | asUfsugcCfaCfCfcacauCfcAf uuucasasa | 344 | UUUGAAAUGGAUGUGG UGGCAAU | 433 |
| AD-69436 | A-139808 | AAAUGGAUGUGGUGGC AAUdTdT | 256 | A-139809 | AUUGCCACCACAUCCA UUUdTdT | 345 | AAAUGGAUGUGGUGGC AAU | 434 |
| AD-69392 | A-139721 | asusggauGfuGfGfUfggcaaug guaL96 | 257 | A-139722 | usAfsccaUfuGfCfcaccAfcAf uccaususu | 346 | AAAUGGAUGUGGUGGC AAUGGUA | 435 |
| AD-69402 | A-139721 | asusggauGfuGfGfUfggcaaug guaL96 | 258 | A-139741 | usAfsccaUfuGfCfcaccAfcAf uccauscsu | 347 | AGAUGGAUGUGGUGGC AAUGGUA | 436 |
| AD-69393 | A-139723 | gsgsauguGfgUfGfGfcaauggu gaaL96 | 259 | A-139724 | usUfscacCfaUfUfgccaCfcAf cauccsasu | 348 | AUGGAUGUGGUGGCAA UGGUGAA | 437 |
| AD-69437 | A-139810 | GGAUGUGGUGGCAAUG GUAdTdT | 260 | A-139811 | UACCAUUGCCACCACA UCCdTdT | 349 | GGAUGUGGUGGCAAUG GUA | 438 |
| AD-69438 | A-139812 | AUGUGGUGGCAAUGGU GAAdTdT | 261 | A-139813 | UUCACCAUUGCCACCA CAUdTdT | 350 | AUGUGGUGGCAAUGGU GAA | 439 |
| AD-69395 | A-139727 | gscsaaugGfuGfAfAfugacacg guaL96 | 262 | A-139728 | usAfsccgUfgUfCfauucAfcCf auugcscsa | 351 | UGGCAAUGGUGAAUGA CACGGUA | 440 |
| AD-69440 | A-139816 | AAUGGUGAAUGACACG GUAdTdT | 263 | A-139817 | UACCGUGUCAUUCACC AUUdTdT | 352 | AAUGGUGAAUGACACG GUA | 441 |
| AD-69396 | A-139729 | csasgugcGfaGfGfUfcggcaug auaL96 | 264 | A-139730 | usAfsucaUfgCfCfgaccUfcGf cacugsasu | 353 | AUCAGUGCGAGGUCGG CAUGAUA | 442 |
| AD-69441 | A-139818 | GUGCGAGGUCGGCAUG AUAdTdT | 265 | A-139819 | UAUCAUGCCGACCUCG CACdTdT | 354 | GUGCGAGGUCGGCAUG AUA | 443 |
| AD-69397 | A-139731 | ascsauggAfgGfAfGfaugcaga auaL96 | 266 | A-139732 | usAfsuucUfgCfAfucucCfuCf caugusasg | 355 | CUACAUGGAGGAGAUG CAGAAUA | 444 |

TABLE 3-continued

GCK Modified Sequences

| Duplex ID | Sense ID | Sense sequence (5'-3') | SEQ ID NO: | Anti-sense ID | Antisense sequence (5'-3') | SEQ ID NO: | mRNA sequence | SEQ ID NO: |
|---|---|---|---|---|---|---|---|---|
| AD-69442 | A-139820 | AUGGAGGAGAUGCAGAAUAdTdT | 267 | A-139821 | UAUUCUGCAUCUCCUCCAUdTdT | 356 | AUGGAGGAGAUGCAGAAUA | 445 |
| AD-69394 | A-139725 | gsasugcaGfaAfUfGfuggagcugguL96 | 268 | A-139726 | asCfscagCfuCfCfacauUfcUfgcaucsusc | 357 | GAGAUGCAGAAUGUGGAGCUGGU | 446 |
| AD-69439 | A-139814 | UGCAGAAUGUGGAGCUGGUdTdT | 269 | A-139815 | ACCAGCUCCACAUUCUGCAdTdT | 358 | UGCAGAAUGUGGAGCUGGU | 447 |
| AD-69398 | A-139733 | gsusggacGfaGfAfGfcucugcaaaaL96 | 270 | A-139734 | usUfsuugCfaGfAfgcucUfcGfuccacscsa | 359 | UGGUGGACGAGAGCUCUGCAAAA | 448 |
| AD-69443 | A-139822 | GGACGAGAGCUCUGCAAAAdTdT | 271 | A-139823 | UUUUGCAGAGCUCUCGUCCdTdT | 360 | GGACGAGAGCUCUGCAAAA | 449 |
| AD-69380 | A-139697 | asasguacAfuGfGfGfcgagcuguaL96 | 272 | A-139698 | usAfsccaGfcUfCfgcccAfuGfuacuusgsc | 361 | GCAAGUACAUGGGCGAGCUGGUA | 450 |
| AD-69425 | A-139786 | GUACAUGGGCGAGCUGGUAdTdT | 273 | A-139787 | UACCAGCUCGCCCAUGUACdTdT | 362 | GUACAUGGGCGAGCUGGUA | 451 |
| AD-69403 | A-139742 | asgsgcucGfuGfGfAfcgaaaacCuaL96 | 274 | A-139743 | usAfsgguUfuUfCfguccAfcGfagccusgsa | 363 | UCAGGCUCGUGGACGAAAACCUA | 452 |
| AD-69447 | A-139830 | GCUCGUGGACGAAAACCUAdTdT | 275 | A-139831 | UAGGUUUUCGUCCACGAGCdTdT | 364 | GCUCGUGGACGAAAACCUA | 453 |
| AD-69404 | A-139744 | csgsugga CfgAfAfAfaccugcucuuL96 | 276 | A-139745 | asAfsgagCfaGfGfuuuuCfgUfccacgsasg | 365 | CUCGUGGACGAAAACCUGCUCUU | 454 |
| AD-69405 | A-139746 | gsusggacGfaAfAfAfccugcucuuaL96 | 277 | A-139747 | usAfsagaGfcAfGfguuuUfcGfuccacgsgsa | 366 | UCGUGGACGAAAACCUGCUCUUA | 455 |
| AD-69448 | A-139832 | UGGACGAAAACCUGCUCUUdTdT | 278 | A-139833 | AAGAGCAGGUUUUCGUCCAdTdT | 367 | UGGACGAAAACCUGCUCUU | 456 |
| AD-69449 | A-139834 | GGACGAAAACCUGCUCUUAdTdT | 279 | A-139835 | UAAGAGCAGGUUUUCGUCCdTdT | 368 | GGACGAAAACCUGCUCUUA | 457 |
| AD-69406 | A-139748 | csgscaagCfaGfAfUfcuacaacauaL96 | 280 | A-139749 | usAfsuguUfgUfAfgaucUfgCfuugcgsgsu | 369 | ACCGCAAGCAGAUCUACAACAUA | 458 |
| AD-69450 | A-139836 | CAAGCAGAUCUACAACAUAdTdT | 281 | A-139837 | UAUGUUGUAGAUCUGCUUGdTdT | 370 | CAAGCAGAUCUACAACAUA | 459 |
| AD-69390 | A-139717 | asgscugcGfaGfAfUfcaccuucauaL96 | 282 | A-139718 | usAfsugaAfgGfUfgaucUfcGfcagcusgsg | 371 | CCAGCUGCGAGAUCACCUUCAUA | 460 |
| AD-69435 | A-139806 | CUGCGAGAUCACCUUCAUAdTdT | 283 | A-139807 | UAUGAAGGUGAUCUCGCAGdTdT | 372 | CUGCGAGAUCACCUUCAUA | 461 |
| AD-69408 | A-139752 | cscsagucCfuGfGfCfcauuuucuuaL96 | 284 | A-139753 | usAfsagaAfaAfUfggccAfgGfacuggsgsu | 373 | ACCCAGUCCUGGCCAUUUUCUUA | 462 |
| AD-69452 | A-139840 | AGUCCUGGCCAUUUUCUUAdTdT | 285 | A-139841 | UAAGAAAAUGGCCAGGACUdTdT | 374 | AGUCCUGGCCAUUUUCUUA | 463 |
| AD-69409 | A-139754 | csascugaGfuGfGfCfuugugaucuL96 | 286 | A-139755 | asGfsaauCfaCfAfagccAfcUfcagugsasu | 375 | AUCACUGAGUGGCUUGUGAUUCU | 464 |
| AD-69453 | A-139842 | CUGAGUGGCUUGUGAUUCUdTdT | 287 | A-139843 | AGAAUCACAAGCCACUCAGdTdT | 376 | CUGAGUGGCUUGUGAUUCU | 465 |
| AD-69410 | A-139756 | asasuguuAfaAfAfGfuuuuaaacauL96 | 288 | A-139757 | asUfsguuUfaAfAfacuuUfAfacauusus u | 377 | AAAAUGUUAAAAGUUUUAAACAU | 466 |
| AD-69454 | A-139844 | UGUUAAAAGUUUUAAACAUdTdT | 289 | A-139845 | AUGUUUAAAACUUUUAACAdTdT | 378 | UGUUAAAAGUUUUAAACAU | 467 |
| AD-69444 | A-139824 | AGCAGAAGGGAACAACAUAdTdT | 290 | A-139825 | UAUGUUGUUCCCUUCUGCUdTdT | 379 | AGCAGAAGGGAACAACAUA | 468 |
| AD-69399 | A-139735 | gsgsagcaGfaAfGfGfgaacaacauaL96 | 291 | A-139736 | usAfsuguUfgUfUfcccuUfcUfgcuccsgsg | 380 | CCGGAGCAGAAGGGAACAACAUA | 469 |

TABLE 3-continued

GCK Modified Sequences

| Duplex ID | Sense ID | Sense sequence (5'-3') | SEQ ID NO: | Anti-sense ID | Antisense sequence (5'-3') | SEQ ID NO: | mRNA sequence | SEQ ID NO: |
|---|---|---|---|---|---|---|---|---|
| AD-69445 | A-139826 | UCUCCGAGAUGCUAUCAAAdTdT | 292 | A-139827 | UUUGAUAGCAUCUCGGAGAdTdT | 381 | UCUCCGAGAUGCUAUCAAA | 470 |
| AD-69400 | A-139737 | csusucucCfgAfGfAfugcuaucaaaL96 | 293 | A-139738 | usUfsugaUfaGfCfaucuCfgGfagaagsusc | 382 | GACUUCUCCGAGAUGCUAUCAAU | 471 |
| AD-69446 | A-139828 | AGAUGGAUGUGGUGGCAAUdTdT | 294 | A-139829 | AUUGCCACCACAUCCAUCUdTdT | 383 | AGAUGGAUGUGGUGGCAAU | 472 |
| AD-69401 | A-139739 | usgsagauGfgAfUfGfugguggcaauL96 | 295 | A-139740 | asUfsugcCfaCfCfacauCfcAfucucasasa | 384 | UUUGAGAUGGAUGUGGUGGCAAU | 473 |
| AD-69451 | A-139838 | CUGCGAAAUCACCUUCAUUdTdT | 296 | A-139839 | AAUGAAGGUGAUUUCGCAGdTdT | 385 | CUGCGAAAUCACCUUCAUU | 474 |
| AD-69407 | A-139750 | asascugcGfaAfAfUfcaccuucauuL96 | 297 | A-139751 | asAfsugaAfgGfUfgauuUfcGfcaguusgsg | 386 | CCAACUGCGAAAUCACCUUCAUU | 475 |

TABLE 4

GCK Single Dose Screen in Primary Mouse Hepatocytes

| Duplex Name | Primary Mouse Hepatocytes | | | |
|---|---|---|---|---|
| | 10 nM Avg | 10 nM SD | 0.1 nM Avg | 0.1 nM SD |
| AD-69366 | 82.2 | 54.1 | 70.2 | 12.8 |
| AD-69368 | 47.8 | 5.3 | 91.7 | 3.6 |
| AD-69411 | 17.6 | 4.8 | 27.9 | 2.8 |
| AD-69413 | 15.9 | 5.1 | 43.7 | 4.8 |
| AD-69367 | 58.2 | 11.0 | 92.0 | 10.5 |
| AD-69369 | 60.3 | 10.6 | 88.0 | 6.5 |
| AD-69412 | 24.1 | 5.3 | 71.7 | 15.6 |
| AD-69414 | 52.5 | 7.7 | 82.7 | 7.2 |
| AD-69371 | 77.5 | 9.7 | 89.1 | 12.3 |
| AD-69416 | 11.8 | 2.4 | 25.1 | 4.0 |
| AD-69370 | 99.5 | 10.1 | 96.9 | 5.1 |
| AD-69415 | 90.3 | 9.3 | 91.3 | 15.2 |
| AD-69372 | 27.9 | 2.2 | 49.8 | 10.2 |
| AD-69417 | 29.9 | 2.1 | 63.6 | 12.6 |
| AD-69373 | 96.7 | 17.1 | 104.7 | 48.8 |
| AD-69418 | 86.2 | 34.0 | 62.0 | 9.9 |
| AD-69374 | 33.7 | 4.8 | 71.7 | 7.8 |
| AD-69419 | 17.1 | 3.2 | 44.8 | 4.4 |
| AD-69375 | 72.0 | 8.3 | 104.5 | 5.3 |
| AD-69420 | 20.3 | 2.0 | 46.6 | 7.2 |
| AD-69376 | 22.1 | 2.3 | 59.0 | 9.7 |
| AD-69377 | 23.0 | 2.0 | 59.2 | 6.6 |
| AD-69421 | 16.1 | 2.1 | 29.9 | 3.5 |
| AD-69422 | 15.2 | 1.2 | 38.9 | 2.4 |
| AD-69378 | 24.8 | 2.1 | 70.1 | 4.2 |
| AD-69379 | 11.2 | 0.9 | 18.0 | 3.2 |
| AD-69423 | 11.7 | 1.3 | 41.1 | 3.6 |
| AD-69424 | 9.5 | 1.6 | 13.9 | 3.5 |
| AD-69381 | 73.6 | 13.3 | 99.9 | 36.4 |
| AD-69426 | 84.5 | 6.3 | 76.5 | 6.1 |
| AD-69382 | 91.9 | 5.6 | 91.6 | 3.3 |
| AD-69427 | 97.6 | 2.5 | 88.8 | 4.5 |
| AD-69383 | 95.9 | 3.2 | 100.5 | 9.3 |
| AD-69428 | 32.7 | 4.3 | 66.1 | 5.0 |
| AD-69384 | 88.3 | 9.8 | 97.9 | 8.6 |
| AD-69429 | 90.7 | 10.6 | 95.9 | 5.7 |
| AD-69385 | 29.2 | 4.2 | 45.1 | 4.4 |
| AD-69386 | 92.5 | 9.0 | 97.8 | 9.8 |
| AD-69430 | 21.2 | 1.4 | 31.8 | 2.1 |
| AD-69387 | 69.7 | 9.0 | 77.8 | 7.1 |
| AD-69432 | 69.5 | 3.2 | 79.6 | 13.6 |
| AD-69388 | 66.9 | 11.3 | 84.7 | 11.9 |
| AD-69389 | 76.3 | 18.3 | 86.9 | 6.0 |
| AD-69433 | 70.0 | 2.6 | 76.4 | 5.0 |
| AD-69434 | 97.6 | 6.6 | 71.6 | 9.5 |
| AD-69391 | 21.7 | 5.1 | 59.8 | 5.6 |
| AD-69436 | 19.9 | 1.9 | 54.3 | 14.6 |
| AD-69392 | 39.2 | 4.8 | 81.5 | 12.7 |
| AD-69402 | 32.2 | 5.1 | 62.9 | 12.4 |
| AD-69393 | 34.9 | 5.4 | 78.5 | 13.0 |
| AD-69437 | 14.0 | 2.5 | 27.3 | 4.6 |
| AD-69438 | 11.7 | 0.7 | 28.4 | 2.5 |
| AD-69395 | 28.2 | 6.8 | 55.4 | 12.2 |
| AD-69440 | 19.4 | 2.8 | 34.7 | 7.3 |
| AD-69396 | 29.7 | 3.0 | 57.2 | 9.8 |
| AD-69441 | 23.8 | 4.1 | 44.6 | 7.4 |
| AD-69397 | 39.5 | 11.8 | 67.9 | 11.6 |
| AD-69442 | 29.3 | 2.4 | 40.1 | 8.4 |
| AD-69394 | 39.4 | 4.2 | 79.5 | 3.2 |
| AD-69439 | 37.6 | 3.2 | 65.9 | 3.0 |
| AD-69398 | 92.2 | 9.6 | 111.3 | 16.2 |
| AD-69443 | 115.1 | 14.5 | 97.4 | 5.1 |
| AD-69380 | 23.6 | 3.2 | 65.0 | 11.2 |
| AD-69425 | 11.9 | 1.2 | 29.4 | 6.5 |
| AD-69403 | 64.2 | 13.0 | 77.0 | 13.9 |
| AD-69447 | 87.4 | 7.9 | 84.3 | 11.7 |
| AD-69404 | 67.2 | 10.6 | 83.9 | 16.6 |
| AD-69405 | 69.0 | 10.9 | 86.1 | 23.6 |
| AD-69448 | 107.8 | 6.4 | 120.4 | 36.9 |
| AD-69449 | 129.6 | 37.4 | 120.2 | 6.4 |
| AD-69406 | 63.8 | 4.7 | 91.7 | 10.8 |
| AD-69450 | 84.5 | 12.4 | 109.5 | 5.3 |
| AD-69390 | 16.9 | 4.2 | 38.9 | 11.6 |
| AD-69435 | 9.0 | 1.5 | 20.9 | 3.5 |
| AD-69408 | 67.3 | 4.7 | 83.6 | 16.3 |
| AD-69452 | 92.6 | 10.4 | 111.8 | 5.1 |
| AD-69409 | 74.8 | 4.8 | 79.7 | 12.3 |
| AD-69453 | 87.2 | 1.4 | 93.7 | 3.0 |
| AD-69410 | 71.2 | 4.9 | 90.2 | 9.4 |
| AD-69454 | 90.0 | 10.9 | 86.0 | 7.8 |
| AD-69399 | 24.4 | 2.5 | 45.8 | 6.1 |
| AD-69445 | 16.0 | 0.6 | 44.4 | 4.4 |
| AD-69400 | 12.2 | 1.4 | 34.8 | 2.3 |
| AD-69446 | 14.9 | 1.3 | 30.4 | 2.9 |

TABLE 4-continued

GCK Single Dose Screen in Primary Mouse Hepatocytes

| Duplex Name | Primary Mouse Hepatocytes | | | |
|---|---|---|---|---|
| | 10 nM Avg | 10 nM SD | 0.1 nM Avg | 0.1 nM SD |
| AD-69401 | 15.4 | 1.6 | 29.4 | 4.9 |
| AD-69451 | 6.9 | 1.3 | 19.2 | 3.6 |
| AD-69407 | 4.1 | 0.4 | 11.8 | 2.8 |
| AD-1955 | 101.283 | 16.1184 | | |

TABLE 5

GCK Single Dose Screen in Primary Cynomologous Hepatocytes

| duplexName | Primary Cyno Hepatocytes | | | |
|---|---|---|---|---|
| | 10 nM Avg | 10 nM SD | 0.1 nM Avg | 0.1 nM SD |
| AD-69366 | 29.8 | 14.3 | 37.4 | 9.3 |
| AD-69368 | 12.2 | 4.6 | 28.1 | 4.9 |
| AD-69411 | 14.2 | 4.5 | 22.6 | 10.8 |
| AD-69413 | 12.1 | 3.2 | 30.0 | 14.0 |
| AD-69367 | 14.9 | 2.6 | 39.9 | 7.1 |
| AD-69369 | 36.6 | 14.2 | 54.2 | 9.5 |
| AD-69412 | 19.3 | 6.5 | 31.2 | 4.6 |
| AD-69414 | 26.4 | 11.9 | 63.6 | 8.7 |
| AD-69371 | 50.2 | 20.5 | 91.3 | 17.3 |
| AD-69416 | 24.5 | 8.3 | 21.8 | 3.6 |
| AD-69370 | 43.4 | 10.3 | 69.4 | 11.6 |
| AD-69415 | 15.4 | 6.2 | 34.2 | 13.2 |
| AD-69372 | 19.8 | 7.9 | 23.7 | 8.7 |
| AD-69417 | 23.8 | 10.5 | 31.4 | 16.1 |
| AD-69373 | 87.7 | 22.1 | 66.8 | 10.6 |
| AD-69418 | 20.4 | 4.9 | 25.7 | 6.4 |
| AD-69374 | 24.7 | 15.0 | 41.8 | 6.2 |
| AD-69419 | 21.9 | 6.7 | 32.8 | 12.9 |
| AD-69375 | 20.6 | 5.5 | 49.5 | 16.0 |
| AD-69420 | 15.3 | 2.9 | 41.8 | 21.6 |
| AD-69376 | 17.7 | 5.3 | 22.4 | 12.1 |
| AD-69377 | 21.6 | 5.6 | 26.4 | 6.2 |
| AD-69421 | 22.1 | 4.7 | 22.1 | 8.9 |
| AD-69422 | 22.7 | 5.7 | 38.2 | 11.8 |
| AD-69378 | 14.7 | 6.6 | 31.9 | 26.2 |
| AD-69379 | 10.5 | 2.7 | 14.4 | 2.9 |
| AD-69423 | 20.3 | 8.2 | 42.2 | 10.8 |
| AD-69424 | 20.0 | 5.1 | 17.5 | 10.3 |
| AD-69381 | 46.6 | 12.8 | 56.9 | 20.6 |
| AD-69426 | 49.3 | 8.4 | 76.7 | 29.0 |
| AD-69382 | 74.0 | 22.7 | 54.6 | 14.2 |
| AD-69427 | 33.9 | 5.9 | 66.3 | 13.8 |
| AD-69383 | 63.4 | 18.6 | 81.4 | 22.7 |
| AD-69428 | 39.4 | 16.0 | 69.7 | 10.0 |
| AD-69384 | 58.1 | 17.4 | 89.1 | 22.8 |
| AD-69429 | 30.9 | 7.3 | 47.9 | 17.9 |
| AD-69385 | 27.3 | 9.2 | 37.0 | 7.7 |
| AD-69386 | 41.4 | 16.6 | 61.3 | 18.6 |
| AD-69430 | 24.2 | 8.8 | 29.8 | 13.7 |
| AD-69387 | 28.2 | 3.0 | 30.9 | 11.1 |
| AD-69432 | 23.5 | 7.8 | 24.4 | 5.3 |
| AD-69388 | 63.7 | 11.0 | 70.8 | 7.3 |
| AD-69389 | 59.7 | 13.8 | 77.8 | 15.6 |
| AD-69433 | 37.0 | 3.3 | 62.2 | 31.0 |
| AD-69434 | 76.3 | 27.9 | 94.1 | 8.0 |
| AD-69391 | 22.0 | 11.2 | 25.2 | 10.0 |
| AD-69436 | 24.5 | 4.8 | 41.3 | 2.7 |
| AD-69392 | 23.3 | 10.1 | 52.9 | 11.4 |
| AD-69402 | 21.9 | 7.6 | 59.1 | 29.2 |
| AD-69393 | 22.9 | 2.3 | 37.3 | 2.9 |
| AD-69437 | 21.8 | 6.6 | 30.4 | 7.7 |
| AD-69438 | 21.5 | 5.9 | 32.4 | 9.6 |
| AD-69395 | 17.4 | 5.7 | 32.3 | 4.6 |
| AD-69440 | 25.7 | 15.0 | 35.1 | 13.5 |
| AD-69396 | 28.8 | 9.3 | 16.6 | 5.1 |
| AD-69441 | 26.3 | 8.4 | 39.2 | 8.9 |
| AD-69397 | 62.4 | 33.3 | 48.6 | 26.1 |
| AD-69442 | 41.0 | 12.3 | 50.4 | 12.5 |

TABLE 5-continued

GCK Single Dose Screen in Primary Cynomologous Hepatocytes

| duplexName | Primary Cyno Hepatocytes | | | |
|---|---|---|---|---|
| | 10 nM Avg | 10 nM SD | 0.1 nM Avg | 0.1 nM SD |
| AD-69394 | 38.0 | 12.9 | 65.7 | 13.1 |
| AD-69439 | 30.2 | 9.0 | 51.6 | 10.8 |
| AD-69398 | 21.1 | 3.8 | 23.1 | 6.5 |
| AD-69443 | 20.0 | 7.6 | 29.3 | 4.2 |
| AD-69380 | 43.8 | 15.3 | 64.7 | 26.0 |
| AD-69425 | 35.5 | 9.8 | 38.5 | 8.5 |
| AD-69403 | 34.5 | 12.0 | 35.1 | 7.0 |
| AD-69447 | 23.5 | 7.4 | 55.0 | 21.7 |
| AD-69404 | 41.2 | 23.9 | 30.0 | 5.5 |
| AD-69405 | 20.2 | 7.7 | 35.0 | 14.4 |
| AD-69448 | 53.1 | 16.4 | 42.3 | 6.3 |
| AD-69449 | 37.8 | 14.7 | 42.6 | 4.0 |
| AD-69406 | 21.6 | 13.7 | 23.4 | 7.1 |
| AD-69450 | 19.6 | 4.5 | 23.9 | 5.1 |
| AD-69390 | 18.8 | 8.0 | 21.0 | 4.2 |
| AD-69435 | 20.0 | 17.3 | 23.9 | 9.7 |
| AD-69408 | 40.0 | 17.9 | 34.1 | 18.5 |
| AD-69452 | 28.9 | 9.6 | 45.5 | 13.6 |
| AD-69409 | 40.0 | 10.8 | 52.7 | 31.5 |
| AD-69453 | 39.2 | 6.5 | 57.6 | 20.9 |
| AD-69410 | 62.0 | 8.7 | 78.6 | 10.5 |
| AD-69454 | 86.5 | 6.9 | 102.4 | 27.8 |
| AD-69399 | 88.8 | 17.5 | 81.6 | 21.4 |
| AD-69445 | 68.9 | 19.5 | 118.3 | 26.5 |
| AD-69400 | 32.7 | 11.9 | 31.1 | 10.1 |
| AD-69446 | 23.5 | 10.8 | 38.3 | 4.1 |
| AD-69401 | 28.4 | 18.3 | 24.7 | 5.7 |
| AD-69451 | 79.6 | 23.5 | 102.9 | 41.6 |
| AD-69407 | 16.8 | 7.7 | 29.2 | 12.6 |
| AD-1955 | 102.912 | 29.2078 | | |

Example 2. iRNA Design, Synthesis, Selection, and In Vitro Evaluation

This Example describes methods for the design, synthesis, selection, and in vitro evaluation of additional GCK iRNA agents.

Bioinformatics

A set of siRNAs targeting human glucokinase (GCK) (human NCBI refseqID: NM_033507; NCBI GeneID: 2645) were designed using custom R and Python scripts. The human GCK REFSEQ mRNA has a length of 2442 bases. The rationale and method for the set of siRNA designs is as follows: the predicted efficacy for every potential 19mer siRNA from position 10 through position 2442 was determined with a linear model derived the direct measure of mRNA knockdown from more than 20,000 distinct siRNA designs targeting a large number of vertebrate genes. The custom Python script built the set of siRNAs by systematically selecting an siRNA every 11 bases along the target mRNA nucleotide sequence starting at position 10. At each of the positions, the neighboring siRNA (one position to the 5' end of the mRNA, one position to the 3' end of the mRNA) was swapped into the design set if the predicted efficacy was better than the efficacy at the exact every-eleventh siRNA. Low complexity siRNAs, e.g., those with Shannon Entropy measures below 1.35, were excluded from the set.

Cell Culture and Transfections

Primary Cyno Hepatocytes (PCH) cells were transfected by adding 4.9 W of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. Forty µl of EMEM containing about $5 \times 10^3$ cells were then added to the siRNA mixture. Cells were incubated for 24 hours prior to RNA purification. Single dose experiments were performed at 20 nM final duplex concentration.

Total RNA Isolation Using DYNABEADS mRNA Isolation Kit

RNA was isolated using an automated protocol on a BioTek-EL406 platform using DYNABEADs (Invitrogen, cat #61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed two times with 150 µl Wash Buffer A and once with Wash Buffer B. Beads were then washed with 150 µl Elution Buffer, re-captured, and the supernatant was removed.

cDNA Synthesis Using ABI High Capacity cDNA Reverse Transcription Kit (Applied Biosystems, Foster City, Calif., Cat #4368813)

Ten µl of a master mix containing 1 µl 10× Buffer, 0.4 µl 25× dNTPs, 1 µl 10× Random primers, 0.5 µl Reverse Transcriptase, 0.5 µl RNase inhibitor and 6.6 µl of $H_2O$ per reaction was added to RNA isolated as described above. Plates were sealed, mixed, and incubated on an electromagnetic shaker for 10 minutes at room temperature, followed by 2 hours at 37° C.

Real Time PCR

Two µl of cDNA were added to a master mix containing 0.5 µl of Custom Cyno GAPDH TaqMan Probe, 0.5 µl cyno GCK probe (Mf02827184 ml) and 5 µl Lightcycler 480 probe master mix (Roche Cat #04887301001) per well in a 384 well plates (Roche cat #04887301001). Real time PCR was performed in a LightCycler480 Real Time PCR system (Roche) using the ΔΔCt(RQ) assay. Each duplex was tested in four independent transfections.

To calculate relative fold change, real time data were analyzed using the ΔΔCt method and normalized to assays performed with cells transfected with 20 nM AD-1955, or mock transfected cells.

A detailed list of the unmodified GCK sense and antisense strand sequences is shown in Table 6 and a detailed list of the modified GCK sense and antisense strand sequences is shown in Table 7.

Table 8 shows the results of a single dose screen in primary Cynomolgus hepatocytes (PCH) transfected with the indicated modified siRNAs. Data are expressed as percent of message remaining relative to cells treated with a non-targeting control siRNA, AD-1955.

TABLE 6

GCK Unmodified Sequences

| Duplex Name | Sense Oligo Name | Sense Sequence (5' to 3') | SEQ ID NO: | Antisense Oligo Name | Sense Sequence (5' to 3') | SEQ ID NO: | Position in NM_033507.1 |
|---|---|---|---|---|---|---|---|
| AD-71009 | A-142377 | CUGCCAGCCUCAGGCAGCU | 476 | A-142378 | AGCUGCCUGAGGCUGGCAG | 684 | 24-42 |
| AD-71010 | A-142379 | UCAGGCAGCUCUCCAUCCA | 477 | A-142380 | UGGAUGGAGAGCUGCCUGA | 685 | 33-51 |
| AD-71011 | A-142381 | CCAUCCAAGCAGCCGUUGA | 478 | A-142382 | UCAACGGCUGCUUGGAUGG | 686 | 45-63 |
| AD-71012 | A-142383 | AGCCGUUGCUGCCACAGGA | 479 | A-142384 | UCCUGUGGCAGCAACGGCU | 687 | 55-73 |
| AD-71013 | A-142385 | ACAGGCGGGCCUUACGCUA | 480 | A-142386 | UAGCGUAAGGCCCGCCUGU | 688 | 68-86 |
| AD-71014 | A-142387 | UUACGCUCCAAGGCUACAA | 481 | A-142388 | UUGUAGCCUUGGAGCGUAA | 689 | 79-97 |
| AD-71015 | A-142389 | AAGGCUACAGCAUGUGCUA | 482 | A-142390 | UAGCACAUGCUGUAGCCUU | 690 | 88-106 |
| AD-71016 | A-142391 | UGUGCUAGGCCUCAGCAGA | 483 | A-142392 | UCUGCUGAGGCCUAGCACA | 691 | 100-118 |
| AD-71017 | A-142393 | UCAGCAGGCAGGAGCAUCU | 484 | A-142394 | AGAUGCUCCUGCCUGCUGA | 692 | 111-129 |
| AD-71018 | A-142395 | AGCAUCUCUGCCUCCCAAA | 485 | A-142396 | UUUGGGAGGCAGAGAUGCU | 693 | 123-141 |
| AD-71019 | A-142397 | CCUCCCAAAGCAUCUACCU | 486 | A-142398 | AGGUAGAUGCUUUGGGAGG | 694 | 133-151 |
| AD-71020 | A-142401 | UAGCCCCUCGGAGAGAUGA | 487 | A-142402 | UCAUCUCUCCGAGGGGCUA | 695 | 154-172 |
| AD-71021 | A-142403 | AGAGAUGGCGAUGGAUGUA | 488 | A-142404 | UACAUCCAUCGCCAUCUCU | 696 | 165-183 |
| AD-71022 | A-142405 | UGGAUGUCACAAGGAGCCA | 489 | A-142406 | UGGCUCCUUGUGACAUCCA | 697 | 176-194 |
| AD-71023 | A-142407 | AGGAGCCAGGCCCAGACAA | 490 | A-142408 | UUGUCUGGGCCUGGCUCCU | 698 | 187-205 |
| AD-71024 | A-142411 | ACUCUGGUAGAGCAGAUCA | 491 | A-142412 | UGAUCUGCUCUACCAGAGU | 699 | 211-229 |
| AD-71025 | A-142413 | AGCAGAUCCUGGCAGAGUU | 492 | A-142414 | AACUCUGCCAGGAUCUGCU | 700 | 221-239 |
| AD-71026 | A-142415 | CAGAGUUCCAGCUGCAGGA | 493 | A-142416 | UCCUGCAGCUGGAACUCUG | 701 | 233-251 |
| AD-71027 | A-142417 | AGCUGCAGGAGGAGGACCU | 494 | A-142418 | AGGUCCUCCUCCUGCAGCU | 702 | 242-260 |
| AD-71028 | A-142419 | AGGACCUGAAGAAGGUGAU | 495 | A-142420 | AUCACCUUCUUCAGGUCCU | 703 | 254-272 |
| AD-71029 | A-142421 | AAGGUGAUGAGACGGAUGA | 496 | A-142422 | UCAUCCGUCUCAUCACCUU | 704 | 265-283 |
| AD-71030 | A-142423 | CGGAUGCAGAAGGAGAUGA | 497 | A-142424 | UCAUCUCCUUCUGCAUCCG | 705 | 277-295 |

TABLE 6-continued

GCK Unmodified Sequences

| Duplex Name | Sense Oligo Name | Sense Sequence (5' to 3') | SEQ ID NO: | Antisense Oligo Name | Sense Sequence (5' to 3') | SEQ ID NO: | Position in NM_033507.1 |
|---|---|---|---|---|---|---|---|
| AD-71031 | A-142425 | AAGGAGAUGGACCGCGGCA | 498 | A-142426 | UGCCGCGGUCCAUCUCCUU | 706 | 286-304 |
| AD-71032 | A-142427 | CGCGGCCUGAGGCUGGAGA | 499 | A-142428 | UCUCCAGCCUCAGGCCGCG | 707 | 298-316 |
| AD-71033 | A-142429 | CUGGAGACCCAUGAAGAGA | 500 | A-142430 | UCUCUUCAUGGGUCUCCAG | 708 | 310-328 |
| AD-71034 | A-142431 | CAUGAAGAGGCCAGUGUGA | 501 | A-142432 | UCACACUGGCCUCUUCAUG | 709 | 319-337 |
| AD-71035 | A-142433 | CAGUGUGAAGAUGCUGCCA | 502 | A-142434 | UGGCAGCAUCUUCACACUG | 710 | 330-348 |
| AD-71036 | A-142435 | UGCUGCCCACCUACGUGCA | 503 | A-142436 | UGCACGUAGGUGGGCAGCA | 711 | 341-359 |
| AD-71037 | A-142437 | UACGUGCGCUCCACCCCAA | 504 | A-142438 | UUGGGGUGGAGCGCACGUA | 712 | 352-370 |
| AD-71038 | A-142439 | ACCCCAGAAGGCUCAGAAA | 505 | A-142440 | UUUCUGAGCCUUCUGGGGU | 713 | 364-382 |
| AD-71039 | A-142441 | UCAGAAGUCGGGACUUCA | 506 | A-142442 | UGAAGUCCCCGACUUCUGA | 714 | 376-394 |
| AD-71040 | A-142443 | GGGGACUUCCUCUCCCUGA | 507 | A-142444 | UCAGGGAGAGGAAGUCCCC | 715 | 385-403 |
| AD-71041 | A-142445 | UCCUGGACCUGGGUGGCA | 508 | A-142446 | UGCCACCCAGGUCCAGGGA | 716 | 397-415 |
| AD-71042 | A-142447 | UGGGUGGCACUAACUUCAA | 509 | A-142448 | UUGAAGUUAGUGCCACCCA | 717 | 407-425 |
| AD-71043 | A-142449 | ACUUCAGGGUGAUGCUGGU | 510 | A-142450 | ACCAGCAUCACCCUGAAGU | 718 | 419-437 |
| AD-71044 | A-142453 | AGGUGGGAGAAGGUGAGGA | 511 | A-142454 | UCCUCACCUUCUCCCACCU | 719 | 440-458 |
| AD-71045 | A-142457 | CAGUGGAGCGUGAAGACCA | 512 | A-142458 | UGGUCUUCACGCUCCACUG | 720 | 463-481 |
| AD-71046 | A-142461 | CCAGAUGUACUCCAUCCCA | 513 | A-142462 | UGGGAUGGAGUACAUCUGG | 721 | 486-504 |
| AD-71047 | A-142467 | ACCGGCACUGCUGAGAUGA | 514 | A-142468 | UCAUCUCAGCAGUGCCGGU | 722 | 517-535 |
| AD-71048 | A-142469 | AGAUGCUCUUCGACUACAU | 515 | A-142470 | AUGUAGUCGAAGAGCAUCU | 723 | 530-548 |
| AD-71049 | A-142471 | UCGACUACAUCUCUGAGUA | 516 | A-142472 | UACUCAGAGAUGUAGUCGA | 724 | 539-557 |
| AD-71050 | A-142473 | UCUGAGUGCAUCUCCGACU | 517 | A-142474 | AGUCGGAGAUGCACUCAGA | 725 | 550-568 |
| AD-71051 | A-142475 | UCCGACUUCCUGGACAAGA | 518 | A-142476 | UCUUGUCCAGGAAGUCGGA | 726 | 562-580 |
| AD-71052 | A-142477 | GACAAGCAUCAGAUGAAAC | 519 | A-142478 | GUUUCAUCUGAUGCUUGUC | 727 | 574-592 |
| AD-71053 | A-142479 | AGAUGAAACACAAGAAGCU | 520 | A-142480 | AGCUUCUUGUGUUUCAUCU | 728 | 584-602 |
| AD-71054 | A-142481 | AGAAGCUGCCCCUGGGCUU | 521 | A-142482 | AAGCCCAGGGGCAGCUUCU | 729 | 596-614 |
| AD-71055 | A-142483 | CCUGGGCUUCACCUUCUCA | 522 | A-142484 | UGAGAAGGUGAAGCCCAGG | 730 | 606-624 |
| AD-71056 | A-142485 | ACCUUCUCCUUUCCUGUGA | 523 | A-142486 | UCACAGGAAAGGAGAAGGU | 731 | 616-634 |
| AD-71057 | A-142487 | CUGUGAGGCACGAAGACAU | 524 | A-142488 | AUGUCUUCGUGCCUCACAG | 732 | 629-647 |
| AD-71058 | A-142489 | GAAGACAUCGAUAAGGGCA | 525 | A-142490 | UGCCCUUAUCGAUGUCUUC | 733 | 640-658 |
| AD-71059 | A-142491 | GAUAAGGGCAUCCUUCUCA | 526 | A-142492 | UGAGAAGGAUGCCCUUAUC | 734 | 649-667 |
| AD-71060 | A-142493 | UUCUCAACUGGACCAAGGA | 527 | A-142494 | UCCUUGGUCCAGUUGAGAA | 735 | 662-680 |
| AD-71061 | A-142495 | ACCAAGGGCUUCAAGGCCU | 528 | A-142496 | AGGCCUUGAAGCCCUUGGU | 736 | 673-691 |
| AD-71062 | A-142497 | CAAGGCCUCAGGAGCAGAA | 529 | A-142498 | UUCUGCUCCUGAGGCCUUG | 737 | 684-702 |
| AD-71063 | A-142499 | AGGAGCAGAAGGGAACAAU | 530 | A-142500 | AUUGUUCCCUUCUGCUCCU | 738 | 693-711 |
| AD-71064 | A-142501 | AACAAUGUCGUGGGCUUA | 531 | A-142502 | UAAGCCCCACGACAUUGUU | 739 | 706-724 |
| AD-71065 | A-142503 | UGGGGCUUCUGCGAGACGA | 532 | A-142504 | UCGUCUCGCAGAAGCCCCA | 740 | 716-734 |
| AD-71066 | A-142505 | CGAGACGCUAUCAAACGGA | 533 | A-142506 | UCCGUUUGAUAGCGUCUCG | 741 | 727-745 |
| AD-71067 | A-142507 | AAACGGAGAGGGACUUUA | 534 | A-142508 | UAAAGUCCCCUCUCCGUUU | 742 | 739-757 |

TABLE 6-continued

GCK Unmodified Sequences

| Duplex Name | Sense Oligo Name | Sense Sequence (5' to 3') | SEQ ID NO: | Antisense Oligo Name | Sense Sequence (5' to 3') | SEQ ID NO: | Position in NM_033507.1 |
|---|---|---|---|---|---|---|---|
| AD-71068 | A-142509 | GGGACUUUGAAAUGGAUGU | 535 | A-142510 | ACAUCCAUUUCAAAGUCCC | 743 | 749-767 |
| AD-71069 | A-142513 | GCAAUGGUGAAUGACACGA | 536 | A-142514 | UCGUGUCAUUCACCAUUGC | 744 | 772-790 |
| AD-71070 | A-142515 | AAUGACACGGUGGCCACGA | 537 | A-142516 | UCGUGGCCACCGUGUCAUU | 745 | 781-799 |
| AD-71071 | A-142517 | GCCACGAUGAUCUCCUGCU | 538 | A-142518 | AGCAGGAGAUCAUCGUGGC | 746 | 793-811 |
| AD-71072 | A-142519 | UCCUGCUACUACGAAGACA | 539 | A-142520 | UGUCUUCGUAGUAGCAGGA | 747 | 805-823 |
| AD-71073 | A-142523 | AGUGCGAGGUCGGCAUGAU | 540 | A-142524 | AUCAUGCCGACCUCGCACU | 748 | 827-845 |
| AD-71074 | A-142525 | GGCAUGAUCGUGGGCACGA | 541 | A-142526 | UCGUGCCCACGAUCAUGCC | 749 | 838-856 |
| AD-71075 | A-142527 | GUGGGCACGGGCUGCAAUA | 542 | A-142528 | UAUUGCAGCCCGUGCCCAC | 750 | 847-865 |
| AD-71076 | A-142529 | UGCAAUGCCUGCUACAUGA | 543 | A-142530 | UCAUGUAGCAGGCAUUGCA | 751 | 859-877 |
| AD-71077 | A-142531 | UACAUGGAGGAGAUGCAGA | 544 | A-142532 | UCUGCAUCUCCUCCAUGUA | 752 | 871-889 |
| AD-71078 | A-142533 | AGAUGCAGAAUGUGGAGCU | 545 | A-142534 | AGCUCCACAUUCUGCAUCU | 753 | 881-899 |
| AD-71079 | A-142535 | UGUGGAGCUGGUGGAGGGA | 546 | A-142536 | UCCCUCCACCAGCUCCACA | 754 | 891-909 |
| AD-71080 | A-142537 | UGGAGGGGACGAGGGCCA | 547 | A-142538 | UGGCCCUCGUCCCCCUCCA | 755 | 902-920 |
| AD-71081 | A-142539 | GAGGGCCGCAUGUGCGUCA | 548 | A-142540 | UGACGCACAUGCGGCCCUC | 756 | 913-931 |
| AD-71082 | A-142541 | UGCGUCAAUACCGAGUGGA | 549 | A-142542 | UCCACUCGGUAUUGACGCA | 757 | 925-943 |
| AD-71083 | A-142543 | CGAGUGGGGCGCCUUCGGA | 550 | A-142544 | UCCGAAGGCGCCCCACUCG | 758 | 936-954 |
| AD-71084 | A-142545 | GCCUUCGGGGACUCCGGCA | 551 | A-142546 | UGCCGGAGUCCCCGAAGGC | 759 | 946-964 |
| AD-71085 | A-142547 | UCCGGCGAGCUGGACGAGU | 552 | A-142548 | ACUCGUCCAGCUCGCCGGA | 760 | 958-976 |
| AD-71086 | A-142549 | GACGAGUUCCUGCUGGAGU | 553 | A-142550 | ACUCCAGCAGGAACUCGUC | 761 | 970-988 |
| AD-71087 | A-142551 | UGCUGGAGUAUGACCGCCU | 554 | A-142552 | AGGCGGUCAUACUCCAGCA | 762 | 980-998 |
| AD-71088 | A-142553 | GACCGCCUGGUGGACGAGA | 555 | A-142554 | UCUCGUCCACCAGGCGGUC | 763 | 991-1009 |
| AD-71089 | A-142555 | GGACGAGAGCUCUGCAAAC | 556 | A-142556 | GUUUGCAGAGCUCUCGUCC | 764 | 1002-1020 |
| AD-71090 | A-142557 | UCUGCAAACCCCGGUCAGA | 557 | A-142558 | UCUGACCGGGGUUUGCAGA | 765 | 1012-1030 |
| AD-71091 | A-142559 | GGUCAGCAGCUGUAUGAGA | 558 | A-142560 | UCUCAUACAGCUGCUGACC | 766 | 1024-1042 |
| AD-71092 | A-142561 | UAUGAGAAGCUCAUAGGUA | 559 | A-142562 | UACCUAUGAGCUUCUCAUA | 767 | 1036-1054 |
| AD-71093 | A-142563 | UCAUAGGUGGCAAGUACAU | 560 | A-142564 | AUGUACUUGCCACCUAUGA | 768 | 1046-1064 |
| AD-71094 | A-142565 | AAGUACAUGGGCGAGCUGA | 561 | A-142566 | UCAGCUCGCCCAUGUACUU | 769 | 1057-1075 |
| AD-71095 | A-142567 | GCGAGCUGGUGCGGCUUGU | 562 | A-142568 | ACAAGCCGCACCAGCUCGC | 770 | 1067-1085 |
| AD-71096 | A-142569 | GGCUUGUGCUGCUCAGGCU | 563 | A-142570 | AGCCUGAGCAGCACAAGCC | 771 | 1079-1097 |
| AD-71097 | A-142571 | UCAGGCUCGUGGACGAAAA | 564 | A-142572 | UUUUCGUCCACGAGCCUGA | 772 | 1091-1109 |
| AD-69448 | A-139832 | UGGACGAAAACCUGCUCUU | 565 | A-139833 | AAGAGCAGGUUUUCGUCCA | 773 | 1100-1118 |
| AD-71098 | A-142573 | UGCUCUUCCACGGGGAGGA | 566 | A-142574 | UCCUCCCCGUGGAAGAGCA | 774 | 1112-1130 |
| AD-71099 | A-142575 | GGGAGGCCUCCGAGCAGCU | 567 | A-142576 | AGCUGCUCGGAGGCCUCCC | 775 | 1124-1142 |
| AD-71100 | A-142577 | CGAGCAGCUGCGCACACGA | 568 | A-142578 | UCGUGUGCGCAGCUGCUCG | 776 | 1134-1152 |
| AD-71101 | A-142581 | AGCCUUCGAGACGCGCUUA | 569 | A-142582 | UAAGCGCGUCUCGAAGGCU | 777 | 1155-1173 |
| AD-71102 | A-142583 | CGCUUCGUGUCGCAGGUGA | 570 | A-142584 | UCACCUGCGCACGAAGCG | 778 | 1168-1186 |
| AD-71103 | A-142585 | UCGCAGGUGGAGAGCGACA | 571 | A-142586 | UGUCGCUCUCCACCUGCGA | 779 | 1177-1195 |

TABLE 6-continued

GCK Unmodified Sequences

| Duplex Name | Sense Oligo Name | Sense Sequence (5' to 3') | SEQ ID NO: | Antissense Oligo Name | Sense Sequence (5' to 3') | SEQ ID NO: | Position in NM_033507.1 |
|---|---|---|---|---|---|---|---|
| AD-71104 | A-142587 | AGCGACACGGGCGACCGCA | 572 | A-142588 | UGCGGUCGCCCGUGUCGCU | 780 | 1189-1207 |
| AD-71105 | A-142589 | CGACCGCAAGCAGAUCUAA | 573 | A-142590 | UUAGAUCUGCUUGCGGUCG | 781 | 1200-1218 |
| AD-71106 | A-142591 | CAGAUCUACAACAUCCUGA | 574 | A-142592 | UCAGGAUGUUGUAGAUCUG | 782 | 1210-1228 |
| AD-71107 | A-142593 | UCCUGAGCACGCUGGGGCU | 575 | A-142594 | AGCCCCAGCGUGCUCAGGA | 783 | 1223-1241 |
| AD-71108 | A-142595 | CUGGGGCUGCGACCCUCGA | 576 | A-142596 | UCGAGGGUCGCAGCCCCAG | 784 | 1234-1252 |
| AD-71109 | A-142597 | CGACCCUCGACCACCGACU | 577 | A-142598 | AGUCGGUGGUCGAGGGUCG | 785 | 1243-1261 |
| AD-71110 | A-142599 | CACCGACUGCGACAUCGUA | 578 | A-142600 | UACGAUGUCGCAGUCGGUG | 786 | 1254-1272 |
| AD-71111 | A-142601 | CAUCGUGCGCCGCGCCUGA | 579 | A-142602 | UCAGGCGCGGCGCACGAUG | 787 | 1266-1284 |
| AD-71112 | A-142603 | CGCGCCUGCGAGAGCGUGU | 580 | A-142604 | ACACGCUCUCGCAGGCGCG | 788 | 1276-1294 |
| AD-71113 | A-142605 | AGCGUGUCUACGCGCGCUA | 581 | A-142606 | UAGCGCGCGUAGACACGCU | 789 | 1288-1306 |
| AD-71114 | A-142607 | CGCGCUGCGCACAUGUGCU | 582 | A-142608 | AGCACAUGUGCGCAGCGCG | 790 | 1300-1318 |
| AD-71115 | A-142609 | ACAUGUGCUCGGCGGGGCU | 583 | A-142610 | AGCCCCGCCGAGCACAUGU | 791 | 1310-1328 |
| AD-71116 | A-142611 | CGGGGCUGGCGGGCGUCAU | 584 | A-142612 | AUGACGCCCGCCAGCCCCG | 792 | 1322-1340 |
| AD-71117 | A-142613 | CGGGCGUCAUCAACCGCAU | 585 | A-142614 | AUGCGGUUGAUGACGCCCG | 793 | 1331-1349 |
| AD-71118 | A-142615 | AACCGCAUGCGCGAGAGCA | 586 | A-142616 | UGCUCUCGCGCAUGCGGUU | 794 | 1342-1360 |
| AD-71119 | A-142617 | AGAGCCGCAGCGAGGACGU | 587 | A-142618 | ACGUCCUCGCUGCGGCUCU | 795 | 1355-1373 |
| AD-71120 | A-142619 | CGAGGACGUAAUGCGCAUA | 588 | A-142620 | UAUGCGCAUUACGUCCUCG | 796 | 1365-1383 |
| AD-71121 | A-142621 | UGCGCAUCACUGUGGGCGU | 589 | A-142622 | ACGCCCACAGUGAUGCGCA | 797 | 1376-1394 |
| AD-71122 | A-142623 | UGGGCGUGGAUGGCUCCGU | 590 | A-142624 | ACGGAGCCAUCCACGCCCA | 798 | 1388-1406 |
| AD-71123 | A-142625 | UGGCUCCGUGUACAAGCUA | 591 | A-142626 | UAGCUUGUACACGGAGCCA | 799 | 1398-1416 |
| AD-71124 | A-142627 | UACAAGCUGCACCCCAGCU | 592 | A-142628 | AGCUGGGGUGCAGCUUGUA | 800 | 1408-1426 |
| AD-71125 | A-142629 | CCAGCUUCAAGGAGCGGUU | 593 | A-142630 | AACCGCUCCUUGAAGCUGG | 801 | 1421-1439 |
| AD-71126 | A-142631 | AGGAGCGGUUCCAUGCCAA | 594 | A-142632 | UUGGCAUGGAACCGCUCCU | 802 | 1430-1448 |
| AD-71127 | A-142633 | AUGCCAGCGUGCGCAGGCU | 595 | A-142634 | AGCCUGCGCACGCUGGCAU | 803 | 1442-1460 |
| AD-71128 | A-142635 | CGCAGGCUGACGCCCAGCU | 596 | A-142636 | AGCUGGGCGUCAGCCUGCG | 804 | 1453-1471 |
| AD-71129 | A-142637 | CCCAGCUGCGAGAUCACCU | 597 | A-142638 | AGGUGAUCUCGCAGCUGGG | 805 | 1465-1483 |
| AD-71130 | A-142639 | GAGAUCACCUUCAUCGAGU | 598 | A-142640 | ACUCGAUGAAGGUGAUCUC | 806 | 1474-1492 |
| AD-71131 | A-142641 | AUCGAGUCGGAGGAGGGCA | 599 | A-142642 | UGCCCUCCUCCGACUCGAU | 807 | 1486-1504 |
| AD-71132 | A-142643 | AGGAGGGCAGUGGCCGGGA | 600 | A-142644 | UCCCGGCCACUGCCCUCCU | 808 | 1496-1514 |
| AD-71133 | A-142645 | CCGGGGCGCGGCCCUGGUA | 601 | A-142646 | UACCAGGGCCGCGCCCCGG | 809 | 1509-1527 |
| AD-71134 | A-142647 | CCCUGGUCUCGGCGGUGGA | 602 | A-142648 | UCCACCGCCGAGACCAGGG | 810 | 1520-1538 |
| AD-71135 | A-142649 | GCGGUGGCCUGUAAGAAGA | 603 | A-142650 | UCUUCUUACAGGCCACCGC | 811 | 1531-1549 |
| AD-71136 | A-142651 | UAAGAAGGCCUGUAUGCUA | 604 | A-142652 | UAGCAUACAGGCCUUCUUA | 812 | 1542-1560 |
| AD-71137 | A-142653 | CUGUAUGCUGGGCCAGUGA | 605 | A-142654 | UCACUGGCCCAGCAUACAG | 813 | 1551-1569 |
| AD-71138 | A-142655 | CAGUGAGAGCAGUGGCCGA | 606 | A-142656 | UCGGCCACUGCUCUCACUG | 814 | 1564-1582 |
| AD-71139 | A-142657 | CAGUGGCCGCAAGCGCAGA | 607 | A-142658 | UCUGCGCUUGCGGCCACUG | 815 | 1573-1591 |
| AD-71140 | A-142659 | AGCGCAGGGAGGAUGCCAA | 608 | A-142660 | UUGGCAUCCUCCCUGCGCU | 816 | 1584-1602 |

TABLE 6-continued

GCK Unmodified Sequences

| Duplex Name | Sense Oligo Name | Sense Sequence (5' to 3') | SEQ ID NO: | Antisense Oligo Name | Sense Sequence (5' to 3') | SEQ ID NO: | Position in NM_033507.1 |
|---|---|---|---|---|---|---|---|
| AD-71141 | A-142661 | UGCCACAGCCCCACAGCAA | 609 | A-142662 | UUGCUGUGGGGCUGUGGCA | 817 | 1597-1615 |
| AD-71142 | A-142663 | CACAGCACCCAGGCUCCAU | 610 | A-142664 | AUGGAGCCUGGGUGCUGUG | 818 | 1608-1626 |
| AD-71143 | A-142665 | AGGCUCCAUGGGGAAGUGA | 611 | A-142666 | UCACUUCCCCAUGGAGCCU | 819 | 1618-1636 |
| AD-71144 | A-142667 | GGAAGUGCUCCCCACACGU | 612 | A-142668 | ACGUGUGGGGAGCACUUCC | 820 | 1629-1647 |
| AD-71145 | A-142669 | CCACACGUGCUCGCAGCCU | 613 | A-142670 | AGGCUGCGAGCACGUGUGG | 821 | 1640-1658 |
| AD-71146 | A-142671 | UCGCAGCCUGGCGGGGCAA | 614 | A-142672 | UUGCCCCGCCAGGCUGCGA | 822 | 1650-1668 |
| AD-71147 | A-142673 | CGGGGCAGGAGGCCUGGCA | 615 | A-142674 | UGCCAGGCCUCCUGCCCCG | 823 | 1661-1679 |
| AD-71148 | A-142675 | CCUGGCCUUGUCAGGACCA | 616 | A-142676 | UGGUCCUGACAAGGCCAGG | 824 | 1673-1691 |
| AD-71149 | A-142677 | CAGGACCCAGGCCGCCUGA | 617 | A-142678 | UCAGGCGGCCUGGGUCCUG | 825 | 1684-1702 |
| AD-71150 | A-142679 | CCGCCUGCCAUACCGCUGA | 618 | A-142680 | UCAGCGGUAUGGCAGGCGG | 826 | 1695-1713 |
| AD-71151 | A-142681 | UACCGCUGGGGAACAGAGA | 619 | A-142682 | UCUCUGUUCCCCAGCGGUA | 827 | 1705-1723 |
| AD-71152 | A-142683 | AACAGAGCGGGCCUCUUCA | 620 | A-142684 | UGAAGAGGCCCGCUCUGUU | 828 | 1716-1734 |
| AD-71153 | A-142685 | CUCUUCCCUCAGUUUUUCA | 621 | A-142686 | UGAAAACUGAGGGAAGAG | 829 | 1728-1746 |
| AD-71154 | A-142687 | UUUUUCGGUGGGACAGCCA | 622 | A-142688 | UGGCUGUCCCACCGAAAAA | 830 | 1740-1758 |
| AD-71155 | A-142689 | GGGACAGCCCCAGGGCCCU | 623 | A-142690 | AGGGCCCUGGGGCUGUCCC | 831 | 1749-1767 |
| AD-71156 | A-142691 | AGGGCCCUAACGGGGGUGA | 624 | A-142692 | UCACCCCGUUAGGGCCCU | 832 | 1760-1778 |
| AD-71157 | A-142693 | GGGUGCGGCAGGAGCAGGA | 625 | A-142694 | UCCUGCUCCUGCCGCACCC | 833 | 1773-1791 |
| AD-71158 | A-142695 | AGGAGCAGGAACAGAGACU | 626 | A-142696 | AGUCUCUGUUCCUGCUCCU | 834 | 1782-1800 |
| AD-71159 | A-142697 | AGAGACUCUGGAAGCCCCA | 627 | A-142698 | UGGGGCUUCCAGAGUCUCU | 835 | 1794-1812 |
| AD-71160 | A-142699 | AAGCCCCCACCUUUCUCA | 628 | A-142700 | UGAGAAAGGUGGGGGCUU | 836 | 1805-1823 |
| AD-71161 | A-142701 | UUUCUCGCUGGAAUCAAUU | 629 | A-142702 | AAUUGAUUCCAGCGAGAAA | 837 | 1817-1835 |
| AD-71162 | A-142703 | AAUCAAUUUCCCAGAAGGA | 630 | A-142704 | UCCUUCUGGGAAAUUGAUU | 838 | 1828-1846 |
| AD-71163 | A-142705 | CCCAGAAGGGAGUUGCUCA | 631 | A-142706 | UGAGCAACUCCCUUCUGGG | 839 | 1837-1855 |
| AD-71164 | A-142707 | UUGCUCACUCAGGACUUUA | 632 | A-142708 | UAAAGUCCUGAGUGAGCAA | 840 | 1849-1867 |
| AD-71165 | A-142709 | AGGACUUUGAUGCAUUUCA | 633 | A-142710 | UGAAAUGCAUCAAAGUCCU | 841 | 1859-1877 |
| AD-71166 | A-142711 | AUUUCCACACUGUCAGAGA | 634 | A-142712 | UCUCUGACAGUGUGGAAAU | 842 | 1872-1890 |
| AD-71167 | A-142713 | UGUCAGAGCUGUUGGCCUA | 635 | A-142714 | UAGGCCAACAGCUCUGACA | 843 | 1882-1900 |
| AD-71168 | A-142715 | UUGGCCUCGCCUGGGCCCA | 636 | A-142716 | UGGGCCCAGGCGAGGCCAA | 844 | 1893-1911 |
| AD-71169 | A-142717 | CUGGGCCCAGGCUCUGGGA | 637 | A-142718 | UCCCAGAGCCUGGGCCCAG | 845 | 1903-1921 |
| AD-71170 | A-142719 | CUCUGGGAAGGGUGCCCU | 638 | A-142720 | AGGGCACCCUUCCCAGAG | 846 | 1914-1932 |
| AD-71171 | A-142721 | UGCCCUCUGGAUCCUGCUA | 639 | A-142722 | UAGCAGGAUCCAGAGGGCA | 847 | 1927-1945 |
| AD-71172 | A-142723 | UCCUGCUGUGGCCUCACUU | 640 | A-142724 | AAGUGAGGCCACAGCAGGA | 848 | 1938-1956 |
| AD-71173 | A-142725 | CCUCACUUCCCUGGGAACU | 641 | A-142726 | AGUUCCCAGGGAAGUGAGG | 849 | 1949-1967 |
| AD-71174 | A-142727 | CUGGGAACUCAUCCUGUGU | 642 | A-142728 | ACACAGGAUGAGUUCCCAG | 850 | 1959-1977 |
| AD-71175 | A-142729 | CCUGUGUGGGGAGGCAGCU | 643 | A-142730 | AGCUGCCUCCCCACACAGG | 851 | 1971-1989 |

TABLE 6-continued

GCK Unmodified Sequences

| Duplex Name | Sense Oligo Name | Sense Sequence (5' to 3') | SEQ ID NO: | Antisense Oligo Name | Sense Sequence (5' to 3') | SEQ ID NO: | Position in NM_033507.1 |
|---|---|---|---|---|---|---|---|
| AD-71176 | A-142731 | GGAGGCAGCUCCAACAGCU | 644 | A-142732 | AGCUGUUGGAGCUGCCUCC | 852 | 1980-1998 |
| AD-71177 | A-142733 | CAACAGCUUGACCAGACCU | 645 | A-142734 | AGGUCUGGUCAAGCUGUUG | 853 | 1991-2009 |
| AD-71178 | A-142735 | CCAGACCUAGACCUGGGCA | 646 | A-142736 | UGCCCAGGUCUAGGUCUGG | 854 | 2002-2020 |
| AD-71179 | A-142737 | CUGGGCCAAAAGGGCAGCA | 647 | A-142738 | UGCUGCCCUUUUGGCCCAG | 855 | 2014-2032 |
| AD-71180 | A-142739 | AGGGCAGCCAGGGGCUGCU | 648 | A-142740 | AGCAGCCCCUGGCUGCCCU | 856 | 2024-2042 |
| AD-71181 | A-142741 | GGGCUGCUCAUCACCCAGU | 649 | A-142742 | ACUGGGUGAUGAGCAGCCC | 857 | 2035-2053 |
| AD-71182 | A-142743 | ACCCAGUCCUGGCCAUUUU | 650 | A-142744 | AAAAUGGCCAGGACUGGGU | 858 | 2047-2065 |
| AD-71183 | A-142745 | GCCAUUUUCUUGCCUGAGA | 651 | A-142746 | UCUCAGGCAAGAAAAUGGC | 859 | 2058-2076 |
| AD-71184 | A-142747 | CCUGAGGCUCAAGAGGCCA | 652 | A-142748 | UGGCCUCUUGAGCCUCAGG | 860 | 2070-2088 |
| AD-71185 | A-142749 | AAGAGGCCCAGGGAGCAAU | 653 | A-142750 | AUUGCUCCCUGGGCCUCUU | 861 | 2080-2098 |
| AD-71186 | A-142751 | GGAGCAAUGGGAGGGGCU | 654 | A-142752 | AGCCCCCUCCCAUUGCUCC | 862 | 2091-2109 |
| AD-71187 | A-142753 | AGGGGGCUCCAUGGAGGAA | 655 | A-142754 | UUCCUCCAUGGAGCCCCCU | 863 | 2102-2120 |
| AD-71188 | A-142755 | GGAGGAGGGUGUCCCAAGCU | 656 | A-142756 | AGCUUGGGACACCUCCUCC | 864 | 2114-2132 |
| AD-71189 | A-142757 | UCCCAAGCUUUGAAUACCA | 657 | A-142758 | UGGUAUUCAAAGCUUGGGA | 865 | 2124-2142 |
| AD-71190 | A-142759 | AAUACCCCAGAGACCUUU | 658 | A-142760 | AAAGGUCUCUGGGGUAUU | 866 | 2136-2154 |
| AD-71191 | A-142761 | AGAGACCUUUUCUCUCCCA | 659 | A-142762 | UGGGAGAGAAAAGGUCUCU | 867 | 2145-2163 |
| AD-71192 | A-142763 | UCUCCCAUACCAUCACUGA | 660 | A-142764 | UCAGUGAUGGUAUGGGAGA | 868 | 2157-2175 |
| AD-71193 | A-142765 | UCACUGAGUGGCUUGUGAU | 661 | A-142766 | AUCACAAGCCACUCAGUGA | 869 | 2169-2187 |
| AD-71194 | A-142767 | GGCUUGUGAUUCUGGGAUA | 662 | A-142768 | UAUCCCAGAAUCACAAGCC | 870 | 2178-2196 |
| AD-71195 | A-142769 | UGGGAUGGACCCUCGCAGA | 663 | A-142770 | UCUGCGAGGGUCCAUCCCA | 871 | 2190-2208 |
| AD-71196 | A-142771 | UCGCAGCAGGUGCAAGAGA | 664 | A-142772 | UCUCUUGCACCUGCUGCGA | 872 | 2202-2220 |
| AD-71197 | A-142773 | UGCAAGAGACAGAGCCCCA | 665 | A-142774 | UGGGGCUCUGUCUCUUGCA | 873 | 2212-2230 |
| AD-71198 | A-142775 | AGAGCCCCAAGCCUCUGA | 666 | A-142776 | UCAGAGGCUUGGGGGCUCU | 874 | 2222-2240 |
| AD-71199 | A-142777 | CUCUGCCCCAAGGGGCCCA | 667 | A-142778 | UGGGCCCCUUGGGGCAGAG | 875 | 2235-2253 |
| AD-71200 | A-142779 | AAGGGGCCCACAAAGGGGA | 668 | A-142780 | UCCCCUUUGUGGGCCCCUU | 876 | 2244-2262 |
| AD-71201 | A-142781 | AAAGGGGAGAAGGGCCAGA | 669 | A-142782 | UCUGGCCCUUCUCCCCUUU | 877 | 2255-2273 |
| AD-71202 | A-142783 | GGGCCAGCCCUACAUCUUA | 670 | A-142784 | UAAGAUGUAGGGCUGGCCC | 878 | 2266-2284 |
| AD-71203 | A-142785 | AUCUUCAGCUCCCAUAGCA | 671 | A-142786 | UGCUAUGGGAGCUGAAGAU | 879 | 2279-2297 |
| AD-71204 | A-142787 | UCCCAUAGCGCUGGCUCAA | 672 | A-142788 | UUGAGCCAGCGCUAUGGGA | 880 | 2288-2306 |
| AD-71205 | A-142789 | UGGCUCAGGAAGAAACCCA | 673 | A-142790 | UGGGUUUCUUCCUGAGCCA | 881 | 2299-2317 |
| AD-71206 | A-142791 | AACCCCAAGCAGCAUUCAA | 674 | A-142792 | UUGAAUGCUGCUUGGGGUU | 882 | 2312-2330 |
| AD-71207 | A-142793 | CAGCAUUCAGCACACCCCA | 675 | A-142794 | UGGGGUGUGCUGAAUGCUG | 883 | 2321-2339 |
| AD-71208 | A-142795 | CACCCCAAGGGACAACCCA | 676 | A-142796 | UGGGUUGUCCCUUGGGGUG | 884 | 2333-2351 |
| AD-71209 | A-142797 | ACAACCCCAUCAUAUGACA | 677 | A-142798 | UGUCAUAUGAUGGGGUUGU | 885 | 2344-2362 |
| AD-71210 | A-142801 | ACCCUCUCCAUGCCCAACA | 678 | A-142802 | UGUUGGGCAUGGAGAGGGU | 886 | 2367-2385 |
| AD-71211 | A-142803 | UGCCCAACCUAAGAUUGUA | 679 | A-142804 | UACAAUCUUAGGUUGGGCA | 887 | 2377-2395 |
| AD-71212 | A-142805 | AAGAUUGUGUGGGUUUUUU | 680 | A-142806 | AAAAAACCCACACAAUCUU | 888 | 2387-2405 |

TABLE 6-continued

GCK Unmodified Sequences

| Duplex Name | Sense Oligo Name | Sense Sequence (5' to 3') | SEQ ID NO: | Antissense Oligo Name | Sense Sequence (5' to 3') | SEQ ID NO: | Position in NM_033507.1 |
|---|---|---|---|---|---|---|---|
| AD-71213 | A-142807 | UUUUUUAAUUAAAAAUGUU | 681 | A-142808 | AACAUUUUUAAUUAAAAAA | 889 | 2400-2418 |
| AD-71214 | A-142809 | UAAAAAUGUUAAAAGUUUU | 682 | A-142810 | AAAACUUUUAACAUUUUUA | 890 | 2409-2427 |
| AD-71215 | A-142811 | AAAGUUUUAAACAUGAAAA | 683 | A-142812 | UUUUCAUGUUUAAAACUUU | 891 | 2420-2438 |

TABLE 7

GCK Modified Sequences

| Duplex Name | Sense Oligo Name | Sense Sequence (5'-3') | SEQ ID NO: | Antissense Oligo Name |
|---|---|---|---|---|
| AD-71009 | A-142377 | CUGCCAGCCUCAGGCAGCUdTdT | 892 | A-142378 |
| AD-71010 | A-142379 | UCAGGCAGCUCUCCAUCCAdTdT | 893 | A-142380 |
| AD-71011 | A-142381 | CCAUCCAAGCAGCCGUUGAdTdT | 894 | A-142382 |
| AD-71012 | A-142383 | AGCCGUUGCUGCCACAGGAdTdT | 895 | A-142384 |
| AD-71013 | A-142385 | ACAGGCGGGCCUUACGCUAdTdT | 896 | A-142386 |
| AD-71014 | A-142387 | UUACGCUCCAAGGCUACAAdTdT | 897 | A-142388 |
| AD-71015 | A-142389 | AAGGCUACAGCAUGUGCUAdTdT | 898 | A-142390 |
| AD-71016 | A-142391 | UGUGCUAGGCCUCAGCAGAdTdT | 899 | A-142392 |
| AD-71017 | A-142393 | UCAGCAGGCAGGAGCAUCUdTdT | 900 | A-142394 |
| AD-71018 | A-142395 | AGCAUCUCUGCCUCCCAAAdTdT | 901 | A-142396 |
| AD-71019 | A-142397 | CCUCCCAAAGCAUCUACCUdTdT | 902 | A-142398 |
| AD-71020 | A-142401 | UAGCCCUCGGAGAGAUGAdTdT | 903 | A-142402 |
| AD-71021 | A-142403 | AGAGAUGGCGAUGGAUGUAdTdT | 904 | A-142404 |
| AD-71022 | A-142405 | UGGAUGUCACAAGGAGCCAdTdT | 905 | A-142406 |
| AD-71023 | A-142407 | AGGAGCCAGGCCCAGACAAdTdT | 906 | A-142408 |
| AD-71024 | A-142411 | ACUCUGGUAGAGCAGAUCdTdT | 907 | A-142412 |
| AD-71025 | A-142413 | AGCAGAUCCUGGCAGAGUUdTdT | 908 | A-142414 |
| AD-71026 | A-142415 | CAGAGUUCCAGCUGCAGGdTdT | 909 | A-142416 |
| AD-71027 | A-142417 | AGCUGCAGGAGGAGGACCUdTdT | 910 | A-142418 |

TABLE 7-continued

| GCK Modified Sequences | | | | |
|---|---|---|---|---|
| AD-71028 | A-142419 | AGGACCUGAAGAAGGUGAUdTdT | 911 | A-142420 |
| AD-71029 | A-142421 | AAGGUGAUGAGACGGAUGAdTdT | 912 | A-142422 |
| AD-71030 | A-142423 | CGGAUGCAGAAGGAGAUGAdTdT | 913 | A-142424 |
| AD-71031 | A-142425 | AAGGAGAUGGACCGCGGCAdTdT | 914 | A-142426 |
| AD-71032 | A-142427 | CGCGGCCUGAGGCUGGAGAdTdT | 915 | A-142428 |
| AD-71033 | A-142429 | CUGGAGACCCAUGAAGAGAdTdT | 916 | A-142430 |
| AD-71034 | A-142431 | CAUGAAGAGGCCAGUGUGAdTdT | 917 | A-142432 |
| AD-71035 | A-142433 | CAGUGUGAAGAUGCUGCCAdTdT | 918 | A-142434 |
| AD-71036 | A-142435 | UGCUGCCCACCUACGUGCAdTdT | 919 | A-142436 |
| AD-71037 | A-142437 | UACGUGCGCUCCACCCCAAdTdT | 920 | A-142438 |
| AD-71038 | A-142439 | ACCCCAGAAGGCUCAGAAAdTdT | 921 | A-142440 |
| AD-71039 | A-142441 | UCAGAAGUCGGGGACUUCAdTdT | 922 | A-142442 |
| AD-71040 | A-142443 | GGGGACUUCCUCUCCCUGAdTdT | 923 | A-142444 |
| AD-71041 | A-142445 | UCCCUGGACCUGGGUGGCAdTdT | 924 | A-142446 |
| AD-71042 | A-142447 | UGGGUGGCACUAACUUCAAdTdT | 925 | A-142448 |
| AD-71043 | A-142449 | ACUUCAGGGUGAUGCUGGUdTdT | 926 | A-142450 |
| AD-71044 | A-142453 | AGGUGGGAGAAGGUGAGGAdTdT | 927 | A-142454 |
| AD-71045 | A-142457 | CAGUGGAGCGUGAAGACCAdTdT | 928 | A-142458 |
| AD-71046 | A-142461 | CCAGAUGUACUCCAUCCCAdTdT | 929 | A-142462 |
| AD-71047 | A-142467 | ACCGGCACUGCUGAGAUGAdTdT | 930 | A-142468 |
| AD-71048 | A-142469 | AGAUGCUCUUCGACUACAUdTdT | 931 | A-142470 |
| AD-71049 | A-142471 | UCGACUACAUCUCUGAGUAdTdT | 932 | A-142472 |
| AD-71050 | A-142473 | UCUGAGUGCAUCUCCGACUdTdT | 933 | A-142474 |
| AD-71051 | A-142475 | UCCGACUUCCUGGACAAGAdTdT | 934 | A-142476 |
| AD-71052 | A-142477 | GACAAGCAUCAGAUGAAACdTdT | 935 | A-142478 |
| AD-71053 | A-142479 | AGAUGAAACACAAGAAGCUdTdT | 936 | A-142480 |

TABLE 7-continued

| GCK Modified Sequences | | | | |
|---|---|---|---|---|
| AD-71054 | A-142481 | AGAAGCUGCCCCUGGGCUUdTdT | 937 | A-142482 |
| AD-71055 | A-142483 | CCUGGGCUUCACCUUCUCAdTdT | 938 | A-142484 |
| AD-71056 | A-142485 | ACCUUCUCCUUUCCUGUGAdTdT | 939 | A-142486 |
| AD-71057 | A-142487 | CUGUGAGGCACGAAGACAUdTdT | 940 | A-142488 |
| AD-71058 | A-142489 | GAAGACAUCGAUAAGGGCAdTdT | 941 | A-142490 |
| AD-71059 | A-142491 | GAUAAGGGCAUCCUUCUCAdTdT | 942 | A-142492 |
| AD-71060 | A-142493 | UUCUCAACUGGACCAAGGAdTdT | 943 | A-142494 |
| AD-71061 | A-142495 | ACCAAGGGCUUCAAGGCCUdTdT | 944 | A-142496 |
| AD-71062 | A-142497 | CAAGGCCUCAGGAGCAGAAdTdT | 945 | A-142498 |
| AD-71063 | A-142499 | AGGAGCAGAAGGGAACAAUdTdT | 946 | A-142500 |
| AD-71064 | A-142501 | AACAAUGUCGUGGGGCUUAdTdT | 947 | A-142502 |
| AD-71065 | A-142503 | UGGGGCUUCUGCGAGACGAdTdT | 948 | A-142504 |
| AD-71066 | A-142505 | CGAGACGCUAUCAAACGGAdTdT | 949 | A-142506 |
| AD-71067 | A-142507 | AAACGGAGAGGGGACUUUAdTdT | 950 | A-142508 |
| AD-71068 | A-142509 | GGGACUUUGAAAUGGAUGUdTdT | 951 | A-142510 |
| AD-71069 | A-142513 | GCAAUGGUGAAUGACACGAdTdT | 952 | A-142514 |
| AD-71070 | A-142515 | AAUGACACGGUGGCCACGAdTdT | 953 | A-142516 |
| AD-71071 | A-142517 | GCCACGAUGAUCUCCUGCUdTdT | 954 | A-142518 |
| AD-71072 | A-142519 | UCCUGCUACUACGAAGACAdTdT | 955 | A-142520 |
| AD-71073 | A-142523 | AGUGCGAGGUCGGCAUGAUdTdT | 956 | A-142524 |
| AD-71074 | A-142525 | GGCAUGAUCGUGGGCACGAdTdT | 957 | A-142526 |
| AD-71075 | A-142527 | GUGGGCACGGGCUGCAAUdTdT | 958 | A-142528 |
| AD-71076 | A-142529 | UGCAAUGCCUGCUACAUGAdTdT | 959 | A-142530 |
| AD-71077 | A-142531 | UACAUGGAGGAGAUGCAGAdTdT | 960 | A-142532 |
| AD-71078 | A-142533 | AGAUGCAGAAUGUGGAGCUdTdT | 961 | A-142534 |
| AD-71079 | A-142535 | UGUGGAGCUGGUGGAGGGAdTdT | 962 | A-142536 |

TABLE 7-continued

| GCK Modified Sequences | | | | |
|---|---|---|---|---|
| AD-71080 | A-142537 | UGGAGGGGGACGAGGGCCAdTdT | 963 | A-142538 |
| AD-71081 | A-142539 | GAGGGCCGCAUGUGCGUCAdTdT | 964 | A-142540 |
| AD-71082 | A-142541 | UGCGUCAAUACCGAGUGGAdTdT | 965 | A-142542 |
| AD-71083 | A-142543 | CGAGUGGGGCGCCUUCGGAdTdT | 966 | A-142544 |
| AD-71084 | A-142545 | GCCUUCGGGGACUCCGGCAdTdT | 967 | A-142546 |
| AD-71085 | A-142547 | UCCGGCGAGCUGGACGAGUdTdT | 968 | A-142548 |
| AD-71086 | A-142549 | GACGAGUUCCUGCUGGAGUdTdT | 969 | A-142550 |
| AD-71087 | A-142551 | UGCUGGAGUAUGACCGCCUdTdT | 970 | A-142552 |
| AD-71088 | A-142553 | GACCGCCUGGUGGACGAGAdTdT | 971 | A-142554 |
| AD-71089 | A-142555 | GGACGAGAGCUCUGCAAACdTdT | 972 | A-142556 |
| AD-71090 | A-142557 | UCUGCAAACCCCGGUCAGAdTdT | 973 | A-142558 |
| AD-71091 | A-142559 | GGUCAGCAGCUGUAUGAGAdTdT | 974 | A-142560 |
| AD-71092 | A-142561 | UAUGAGAAGCUCAUAGGUdTdT | 975 | A-142562 |
| AD-71093 | A-142563 | UCAUAGGUGGCAAGUACAUdTdT | 976 | A-142564 |
| AD-71094 | A-142565 | AAGUACAUGGGCGAGCUGAdTdT | 977 | A-142566 |
| AD-71095 | A-142567 | GCGAGCUGGUGCGGCUUGUdTdT | 978 | A-142568 |
| AD-71096 | A-142569 | GGCUUGUGCUGCUCAGGCUdTdT | 979 | A-142570 |
| AD-71097 | A-142571 | UCAGGCUCGUGGACGAAAAdTdT | 980 | A-142572 |
| AD-69448 | A-139832 | UGGACGAAAACCUGCUCUUdTdT | 981 | A-139833 |
| AD-71098 | A-142573 | UGCUCUUCCACGGGGAGGAdTdT | 982 | A-142574 |
| AD-71099 | A-142575 | GGGAGGCCUCCGAGCAGCUdTdT | 983 | A-142576 |
| AD-71100 | A-142577 | CGAGCAGCUGCGCACACGAdTdT | 984 | A-142578 |
| AD-71101 | A-142581 | AGCCUUCGAGACGCGCUUdTdT | 985 | A-142582 |
| AD-71102 | A-142583 | CGCUUCGUGUCGCAGGUGAdTdT | 986 | A-142584 |
| AD-71103 | A-142585 | UCGCAGGUGGAGAGCGACAdTdT | 987 | A-142586 |
| AD-71104 | A-142587 | AGCGACACGGGCGACCGCAdTdT | 988 | A-142588 |

TABLE 7-continued

GCK Modified Sequences

| | | | |
|---|---|---|---|
| AD-71105 | A-142589 | CGACCGCAAGCAGAUCUAAdTdT | 989 | A-142590 |
| AD-71106 | A-142591 | CAGAUCUACAACAUCCUGAdTdT | 990 | A-142592 |
| AD-71107 | A-142593 | UCCUGAGCACGCUGGGGCUdTdT | 991 | A-142594 |
| AD-71108 | A-142595 | CUGGGGCUGCGACCCUCGAdTdT | 992 | A-142596 |
| AD-71109 | A-142597 | CGACCCUCGACCACCGACUdTdT | 993 | A-142598 |
| AD-71110 | A-142599 | CACCGACUGCGACAUCGUAdTdT | 994 | A-142600 |
| AD-71111 | A-142601 | CAUCGUGCGCCGCGCCUGAdTdT | 995 | A-142602 |
| AD-71112 | A-142603 | CGCGCCUGCGAGAGCGUGUdTdT | 996 | A-142604 |
| AD-71113 | A-142605 | AGCGUGUCUACGCGCGCUAdTdT | 997 | A-142606 |
| AD-71114 | A-142607 | CGCGCUGCGCACAUGUGCUdTdT | 998 | A-142608 |
| AD-71115 | A-142609 | ACAUGUGCUCGGCGGGGCUdTdT | 999 | A-142610 |
| AD-71116 | A-142611 | CGGGGCUGGCGGGCGUCAUdTdT | 1000 | A-142612 |
| AD-71117 | A-142613 | CGGGCGUCAUCAACCGCAUdTdT | 1001 | A-142614 |
| AD-71118 | A-142615 | AACCGCAUGCGCGAGAGCAdTdT | 1002 | A-142616 |
| AD-71119 | A-142617 | AGAGCCGCAGCGAGGACGUdTdT | 1003 | A-142618 |
| AD-71120 | A-142619 | CGAGGACGUAAUGCGCAUAdTdT | 1004 | A-142620 |
| AD-71121 | A-142621 | UGCGCAUCACUGUGGGCGUdTdT | 1005 | A-142622 |
| AD-71122 | A-142623 | UGGGCGUGGAUGGCUCCGUdTdT | 1006 | A-142624 |
| AD-71123 | A-142625 | UGGCUCCGUGUACAAGCUdTdT | 1007 | A-142626 |
| AD-71124 | A-142627 | UACAAGCUGCACCCCAGCUdTdT | 1008 | A-142628 |
| AD-71125 | A-142629 | CCAGCUUCAAGGAGCGGUUdTdT | 1009 | A-142630 |
| AD-71126 | A-142631 | AGGAGCGGUUCCAUGCCAAdTdT | 1010 | A-142632 |
| AD-71127 | A-142633 | AUGCCAGCGUGCGCAGGCUdTdT | 1011 | A-142634 |
| AD-71128 | A-142635 | CGCAGGCUGACGCCCAGCUdTdT | 1012 | A-142636 |
| AD-71129 | A-142637 | CCCAGCUGCGAGAUCACCUdTdT | 1013 | A-142638 |
| AD-71130 | A-142639 | GAGAUCACCUUCAUCGAGUdTdT | 1014 | A-142640 |

TABLE 7-continued

| GCK Modified Sequences | | | |
|---|---|---|---|
| AD-71131 | A-142641 | AUCGAGUCGGAGGAGGGCAdTdT | 1015 | A-142642 |
| AD-71132 | A-142643 | AGGAGGGCAGUGGCCGGGAdTdT | 1016 | A-142644 |
| AD-71133 | A-142645 | CCGGGGCGCGGCCCUGGUAdTdT | 1017 | A-142646 |
| AD-71134 | A-142647 | CCCUGGUCUCGGCGGUGGAdTdT | 1018 | A-142648 |
| AD-71135 | A-142649 | GCGGUGGCCUGUAAGAAGAdTdT | 1019 | A-142650 |
| AD-71136 | A-142651 | UAAGAAGGCCUGUAUGCUAdTdT | 1020 | A-142652 |
| AD-71137 | A-142653 | CUGUAUGCUGGGCCAGUGAdTdT | 1021 | A-142654 |
| AD-71138 | A-142655 | CAGUGAGAGCAGUGGCCGAdTdT | 1022 | A-142656 |
| AD-71139 | A-142657 | CAGUGGCCGCAAGCGCAGAdTdT | 1023 | A-142658 |
| AD-71140 | A-142659 | AGCGCAGGGAGGAUGCCAAdTdT | 1024 | A-142660 |
| AD-71141 | A-142661 | UGCCACAGCCCCACAGCAAdTdT | 1025 | A-142662 |
| AD-71142 | A-142663 | CACAGCACCCAGGCUCCAUdTdT | 1026 | A-142664 |
| AD-71143 | A-142665 | AGGCUCCAUGGGGAAGUGAdTdT | 1027 | A-142666 |
| AD-71144 | A-142667 | GGAAGUGCUCCCCACACGUdTdT | 1028 | A-142668 |
| AD-71145 | A-142669 | CCACACGUGCUCGCAGCCUdTdT | 1029 | A-142670 |
| AD-71146 | A-142671 | UCGCAGCCUGGCGGGGCAAdTdT | 1030 | A-142672 |
| AD-71147 | A-142673 | CGGGGCAGGAGGCCUGGCAdTdT | 1031 | A-142674 |
| AD-71148 | A-142675 | CCUGGCCUUGUCAGGACCAdTdT | 1032 | A-142676 |
| AD-71149 | A-142677 | CAGGACCCAGGCCGCCUGAdTdT | 1033 | A-142678 |
| AD-71150 | A-142679 | CCGCCUGCCAUACCGCUGAdTdT | 1034 | A-142680 |
| AD-71151 | A-142681 | UACCGCUGGGGAACAGAGAdTdT | 1035 | A-142682 |
| AD-71152 | A-142683 | AACAGAGCGGGCCUCUUCAdTdT | 1036 | A-142684 |
| AD-71153 | A-142685 | CUCUUCCCUCAGUUUUUCAdTdT | 1037 | A-142686 |
| AD-71154 | A-142687 | UUUUUCGGUGGGACAGCCAdTdT | 1038 | A-142688 |
| AD-71155 | A-142689 | GGGACAGCCCCAGGGCCCUdTdT | 1039 | A-142690 |
| AD-71156 | A-142691 | AGGGCCCUAACGGGGGUGAdTdT | 1040 | A-142692 |

TABLE 7-continued

| GCK Modified Sequences | | | |
|---|---|---|---|
| AD-71157 A-142693 | GGGUGCGGCAGGAGCAGGAdTdT | 1041 | A-142694 |
| AD-71158 A-142695 | AGGAGCAGGAACAGAGACUdTdT | 1042 | A-142696 |
| AD-71159 A-142697 | AGAGACUCUGGAAGCCCCAdTdT | 1043 | A-142698 |
| AD-71160 A-142699 | AAGCCCCCACCUUUCUCAdTdT | 1044 | A-142700 |
| AD-71161 A-142701 | UUUCUCGCUGGAAUCAAUUdTdT | 1045 | A-142702 |
| AD-71162 A-142703 | AAUCAAUUCCCAGAAGGAdTdT | 1046 | A-142704 |
| AD-71163 A-142705 | CCCAGAAGGGAGUUGCUCAdTdT | 1047 | A-142706 |
| AD-71164 A-142707 | UUGCUCACUCAGGACUUUAdTdT | 1048 | A-142708 |
| AD-71165 A-142709 | AGGACUUUGAUGCAUUUCAdTdT | 1049 | A-142710 |
| AD-71166 A-142711 | AUUCCACACUGUCAGAGAdTdT | 1050 | A-142712 |
| AD-71167 A-142713 | UGUCAGAGCUGUUGGCCUAdTdT | 1051 | A-142714 |
| AD-71168 A-142715 | UUGGCCUCGCCUGGGCCCAdTdT | 1052 | A-142716 |
| AD-71169 A-142717 | CUGGGCCCAGGCUCUGGGAdTdT | 1053 | A-142718 |
| AD-71170 A-142719 | CUCUGGGAAGGGGUGCCCUdTdT | 1054 | A-142720 |
| AD-71171 A-142721 | UGCCCUCUGGAUCCUGCUdTdT | 1055 | A-142722 |
| AD-71172 A-142723 | UCCUGCUGUGGCCUCACUUdTdT | 1056 | A-142724 |
| AD-71173 A-142725 | CCUCACUUCCCUGGGAACUdTdT | 1057 | A-142726 |
| AD-71174 A-142727 | CUGGGAACUCAUCCUGUGdTdT | 1058 | A-142728 |
| AD-71175 A-142729 | CCUGUGUGGGGAGGCAGCUdTdT | 1059 | A-142730 |
| AD-71176 A-142731 | GGAGGCAGCUCCAACAGCUdTdT | 1060 | A-142732 |
| AD-71177 A-142733 | CAACAGCUUGACCAGACCUdTdT | 1061 | A-142734 |
| AD-71178 A-142735 | CCAGACCUAGACCUGGGCAdTdT | 1062 | A-142736 |
| AD-71179 A-142737 | CUGGGCCAAAAGGGCAGCAdTdT | 1063 | A-142738 |
| AD-71180 A-142739 | AGGGCAGCCAGGGGCUGCUdTdT | 1064 | A-142740 |
| AD-71181 A-142741 | GGGCUGCUCAUCACCCAGdTdT | 1065 | A-142742 |
| AD-71182 A-142743 | ACCCAGUCCUGGCCAUUUUdTdT | 1066 | A-142744 |

TABLE 7-continued

GCK Modified Sequences

| | | | |
|---|---|---|---|
| AD-71183 | A-142745 | GCCAUUUUCUUGCCUG AGAdTdT | 1067 | A-142746 |
| AD-71184 | A-142747 | CCUGAGGCUCAAGAGG CCAdTdT | 1068 | A-142748 |
| AD-71185 | A-142749 | AAGAGGCCCAGGGAGC AAUdTdT | 1069 | A-142750 |
| AD-71186 | A-142751 | GGAGCAAUGGGAGGGG GCUdTdT | 1070 | A-142752 |
| AD-71187 | A-142753 | AGGGGGCUCCAUGGAG GAAdTdT | 1071 | A-142754 |
| AD-71188 | A-142755 | GGAGGAGGUGUCCCAA GCUdTdT | 1072 | A-142756 |
| AD-71189 | A-142757 | UCCCAAGCUUUGAAUA CCAdTdT | 1073 | A-142758 |
| AD-71190 | A-142759 | AAUACCCCAGAGACC UUUdTdT | 1074 | A-142760 |
| AD-71191 | A-142761 | AGAGACCUUUUCUCUC CCAdTdT | 1075 | A-142762 |
| AD-71192 | A-142763 | UCUCCCAUACCAUCAC UGAdTdT | 1076 | A-142764 |
| AD-71193 | A-142765 | UCACUGAGUGGCUUGU GAUdTdT | 1077 | A-142766 |
| AD-71194 | A-142767 | GGCUUGUGAUUCUGGG AUAdTdT | 1078 | A-142768 |
| AD-71195 | A-142769 | UGGGAUGGACCCUCGC AGAdTdT | 1079 | A-142770 |
| AD-71196 | A-142771 | UCGCAGCAGGUGCAAG AGAdTdT | 1080 | A-142772 |
| AD-71197 | A-142773 | UGCAAGAGACAGAGCC CCAdTdT | 1081 | A-142774 |
| AD-71198 | A-142775 | AGAGCCCCCAAGCCUC UGAdTdT | 1082 | A-142776 |
| AD-71199 | A-142777 | CUCUGCCCCAAGGGGC CCAdTdT | 1083 | A-142778 |
| AD-71200 | A-142779 | AAGGGGCCCACAAAGG GGAdTdT | 1084 | A-142780 |
| AD-71201 | A-142781 | AAAGGGGAGAAGGGCC AGAdTdT | 1085 | A-142782 |
| AD-71202 | A-142783 | GGGCCAGCCCUACAUC UUAdTdT | 1086 | A-142784 |
| AD-71203 | A-142785 | AUCUUCAGCUCCCAUA GCAdTdT | 1087 | A-142786 |
| AD-71204 | A-142787 | UCCCAUAGCGCUGGCU CAAdTdT | 1088 | A-142788 |
| AD-71205 | A-142789 | UGGCUCAGGAAGAAAC CCAdTdT | 1089 | A-142790 |
| AD-71206 | A-142791 | AACCCCAAGCAGCAUU CAAdTdT | 1090 | A-142792 |
| AD-71207 | A-142793 | CAGCAUUCAGCACACC CCAdTdT | 1091 | A-142794 |
| AD-71208 | A-142795 | CACCCCAAGGGACAAC CCAdTdT | 1092 | A-142796 |

TABLE 7-continued

| | | GCK Modified Sequences | | |
|---|---|---|---|---|
| AD-71209 | A-142797 | ACAACCCCAUCAUAUGACAdTdT | 1093 | A-142798 |
| AD-71210 | A-142801 | ACCCUCUCCAUGCCCAACAdTdT | 1094 | A-142802 |
| AD-71211 | A-142803 | UGCCCAACCUAAGAUUGUAdTdT | 1095 | A-142804 |
| AD-71212 | A-142805 | AAGAUUGUGUGGGUUUUUUdTdT | 1096 | A-142806 |
| AD-71213 | A-142807 | UUUUUUAAUUAAAAAUGUUdTdT | 1097 | A-142808 |
| AD-71214 | A-142809 | UAAAAAUGUUAAAAGUUUUdTdT | 1098 | A-142810 |
| AD-71215 | A-142811 | AAAGUUUUAAACAUGAAAAdTdT | 1099 | A-142812 |

| Duplex Name | Antisense Sequence (5'-3') | SEQ ID NO: | mRNA target sequence | SEQ ID NO: |
|---|---|---|---|---|
| AD-71009 | AGCUGCCUGAGGCUGGCAGdTdT | 1100 | CUGCCAGCCUCAGGCAGCU | 1308 |
| AD-71010 | UGGAUGGAGAGCUGCCUGAdTdT | 1101 | UCAGGCAGCUCUCCAUCCA | 1309 |
| AD-71011 | UCAACGGCUGCUUGGAUGGdTdT | 1102 | CCAUCCAAGCAGCCGUUGC | 1310 |
| AD-71012 | UCCUGUGGCAGCAACGGCUdTdT | 1103 | AGCCGUUGCUGCCACAGGC | 1311 |
| AD-71013 | UAGCGUAAGGCCCGCCUGUdTdT | 1104 | ACAGGCGGGCCUUACGCUC | 1312 |
| AD-71014 | UUGUAGCCUUGGAGCGUAAdTdT | 1105 | UUACGCUCCAAGGCUACAG | 1313 |
| AD-71015 | UAGCACAUGCUGUAGCCUUdTdT | 1106 | AAGGCUACAGCAUGUGCUA | 1314 |
| AD-71016 | UCUGCUGAGGCCUAGCACAdTdT | 1107 | UGUGCUAGGCCUCAGCAGG | 1315 |
| AD-71017 | AGAUGCUCCUGCCUGCUGAdTdT | 1108 | UCAGCAGGCAGGAGCAUCU | 1316 |
| AD-71018 | UUUGGGAGGCAGAGAUGCUdTdT | 1109 | AGCAUCUCUGCCUCCCAAA | 1317 |
| AD-71019 | AGGUAGAUGCUUUGGGAGGdTdT | 1110 | CCUCCCAAAGCAUCUACCU | 1318 |
| AD-71020 | UCAUCUCUCCGAGGGGCUAdTdT | 1111 | UAGCCCCUCGGAGAGAUGG | 1319 |
| AD-71021 | UACAUCCAUCGCCAUCUCUdTdT | 1112 | AGAGAUGGCGAUGGAUGUC | 1320 |
| AD-71022 | UGGCUCCUUGUGACAUCCAdTdT | 1113 | UGGAUGUCACAAGGAGCCA | 1321 |
| AD-71023 | UUGUCUGGGCCUGGCUCCUdTdT | 1114 | AGGAGCCAGGCCCAGACAG | 1322 |
| AD-71024 | UGAUCUGCUCUACCAGAGUdTdT | 1115 | ACUCUGGUAGAGCAGAUCC | 1323 |
| AD-71025 | AACUCUGCCAGGAUCUGCUdTdT | 1116 | AGCAGAUCCUGGCAGAGUU | 1324 |
| AD-71026 | UCCUGCAGCUGGAACUCUGdTdT | 1117 | CAGAGUUCCAGCUGCAGGA | 1325 |

TABLE 7-continued

GCK Modified Sequences

| | | | |
|---|---|---|---|
| AD-71027 | AGGUCCUCCUCCUGCAGCUdTdT | 1118 | AGCUGCAGGAGGAGGACCU | 1326 |
| AD-71028 | AUCACCUUCUUCAGGUCCUdTdT | 1119 | AGGACCUGAAGAAGGUGAU | 1327 |
| AD-71029 | UCAUCCGUCUCAUCACCUUdTdT | 1120 | AAGGUGAUGAGACGGAUGC | 1328 |
| AD-71030 | UCAUCUCCUUCUGCAUCCGdTdT | 1121 | CGGAUGCAGAAGGAGAUGG | 1329 |
| AD-71031 | UGCCGCGGUCCAUCUCCUUdTdT | 1122 | AAGGAGAUGGACCGCGGCC | 1330 |
| AD-71032 | UCUCCAGCCUCAGGCCGCGdTdT | 1123 | CGCGGCCUGAGGCUGGAGA | 1331 |
| AD-71033 | UCUCUUCAUGGGUCUCCAGdTdT | 1124 | CUGGAGACCCAUGAAGAGG | 1332 |
| AD-71034 | UCACACUGGCCUCUUCAUGdTdT | 1125 | CAUGAAGAGGCCAGUGUGA | 1333 |
| AD-71035 | UGGCAGCAUCUUCACACUGdTdT | 1126 | CAGUGUGAAGAUGCUGCCC | 1334 |
| AD-71036 | UGCACGUAGGUGGGCAGCAdTdT | 1127 | UGCUGCCCACCUACGUGCG | 1335 |
| AD-71037 | UUGGGGUGGAGCGCACGUAdTdT | 1128 | UACGUGCGCUCCACCCCAG | 1336 |
| AD-71038 | UUUCUGAGCCUUCUGGGGUdTdT | 1129 | ACCCCAGAAGGCUCAGAAG | 1337 |
| AD-71039 | UGAAGUCCCCGACUUCUGAdTdT | 1130 | UCAGAAGUCGGGGACUUCC | 1338 |
| AD-71040 | UCAGGGAGAGGAAGUCCCCdTdT | 1131 | GGGGACUUCCUCUCCCUGG | 1339 |
| AD-71041 | UGCCACCCAGGUCCAGGGAdTdT | 1132 | UCCCUGGACCUGGGUGGCA | 1340 |
| AD-71042 | UUGAAGUUAGUGCCACCCAdTdT | 1133 | UGGGUGGCACUAACUUCAG | 1341 |
| AD-71043 | ACCAGCAUCACCCUGAAGUdTdT | 1134 | ACUUCAGGGUGAUGCUGGU | 1342 |
| AD-71044 | UCCUCACCUUCUCCCACCUdTdT | 1135 | AGGUGGGAGAAGGUGAGGA | 1343 |
| AD-71045 | UGGUCUUCACGCUCCACUGdTdT | 1136 | CAGUGGAGCGUGAAGACCA | 1344 |
| AD-71046 | UGGGAUGGAGUACAUCUGGdTdT | 1137 | CCAGAUGUACUCCAUCCCC | 1345 |
| AD-71047 | UCAUCUCAGCAGUGCCGGdTdT | 1138 | ACCGGCACUGCUGAGAUGC | 1346 |
| AD-71048 | AUGUAGUCGAAGAGCAUCUdTdT | 1139 | AGAUGCUCUUCGACUACAU | 1347 |
| AD-71049 | UACUCAGAGAUGUAGUCGAdTdT | 1140 | UCGACUACAUCUCUGAGUG | 1348 |
| AD-71050 | AGUCGGAGAUGCACUCAGAdTdT | 1141 | UCUGAGUGCAUCUCCGACU | 1349 |
| AD-71051 | UCUUGUCCAGGAAGUCGGAdTdT | 1142 | UCCGACUUCCUGGACAAGC | 1350 |
| AD-71052 | GUUUCAUCUGAUGCUUGUCdTdT | 1143 | GACAAGCAUCAGAUGAAAC | 1351 |

TABLE 7-continued

GCK Modified Sequences

| | | | |
|---|---|---|---|
| AD-71053 | AGCUUCUUGUGUUUCAUCUdTdT | 1144 | AGAUGAAACACAAGAAGCU | 1352 |
| AD-71054 | AAGCCCAGGGGCAGCUUCUdTdT | 1145 | AGAAGCUGCCCCUGGGCUU | 1353 |
| AD-71055 | UGAGAAGGUGAAGCCCAGGdTdT | 1146 | CCUGGGCUUCACCUUCUCC | 1354 |
| AD-71056 | UCACAGGAAAGGAGAAGGdTdT | 1147 | ACCUUCUCCUUUCCUGUGA | 1355 |
| AD-71057 | AUGUCUUCGUGCCUCACAGdTdT | 1148 | CUGUGAGGCACGAAGACAU | 1356 |
| AD-71058 | UGCCCUUAUCGAUGUCUUCdTdT | 1149 | GAAGACAUCGAUAAGGGCA | 1357 |
| AD-71059 | UGAGAAGGAUGCCCUUAUCdTdT | 1150 | GAUAAGGGCAUCCUUCUCA | 1358 |
| AD-71060 | UCCUUGGUCCAGUUGAGAAdTdT | 1151 | UUCUCAACUGGACCAAGGG | 1359 |
| AD-71061 | AGGCCUUGAAGCCCUUGGUdTdT | 1152 | ACCAAGGGCUUCAAGGCCU | 1360 |
| AD-71062 | UUCUGCUCCUGAGGCCUUGdTdT | 1153 | CAAGGCCUCAGGAGCAGAA | 1361 |
| AD-71063 | AUUGUUCCCUUCUGCUCCUdTdT | 1154 | AGGAGCAGAAGGGAACAAU | 1362 |
| AD-71064 | UAAGCCCCACGACAUUGUUdTdT | 1155 | AACAAUGUCGUGGGCUUC | 1363 |
| AD-71065 | UCGUCUCGCAGAAGCCCCAdTdT | 1156 | UGGGGCUUCUGCGAGACGC | 1364 |
| AD-71066 | UCCGUUUGAUAGCGUCUCGdTdT | 1157 | CGAGACGCUAUCAAACGGA | 1365 |
| AD-71067 | UAAAGUCCCCUCUCCGUUUdTdT | 1158 | AAACGGAGAGGGGACUUUG | 1366 |
| AD-71068 | ACAUCCAUUUCAAAGUCCCdTdT | 1159 | GGGACUUUGAAAUGGAUGU | 1367 |
| AD-71069 | UCGUGUCAUUCACCAUUGCdTdT | 1160 | GCAAUGGUGAAUGACACGG | 1368 |
| AD-71070 | UCGUGGCCACCGUGUCAUUdTdT | 1161 | AAUGACACGGUGGCCACGA | 1369 |
| AD-71071 | AGCAGGAGAUCAUCGUGGCdTdT | 1162 | GCCACGAUGAUCUCCUGCU | 1370 |
| AD-71072 | UGUCUUCGUAGUAGCAGGAdTdT | 1163 | UCCUGCUACUACGAAGACC | 1371 |
| AD-71073 | AUCAUGCCGACCUCGCACUdTdT | 1164 | AGUGCGAGGUCGGCAUGAU | 1372 |
| AD-71074 | UCGUGCCCACGAUCAUGCCdTdT | 1165 | GGCAUGAUCGUGGGCACGG | 1373 |
| AD-71075 | UAUUGCAGCCCGUGCCCACdTdT | 1166 | GUGGGCACGGGCUGCAAUG | 1374 |
| AD-71076 | UCAUGUAGCAGGCAUUGCAdTdT | 1167 | UGCAAUGCCUGCUACAUGG | 1375 |
| AD-71077 | UCUGCAUCUCCUCCAUGUAdTdT | 1168 | UACAUGGAGGAGAUGCAGA | 1376 |
| AD-71078 | AGCUCCACAUUCUGCAUCUdTdT | 1169 | AGAUGCAGAAUGUGGAGCU | 1377 |

TABLE 7-continued

GCK Modified Sequences

| | | | |
|---|---|---|---|
| AD-71079 | UCCCUCCACCAGCUCCACAdTdT | 1170 UGUGGAGCUGGUGGAGGGG | 1378 |
| AD-71080 | UGGCCCUCGUCCCCCUCCAdTdT | 1171 UGGAGGGGACGAGGGCCG | 1379 |
| AD-71081 | UGACGCACAUGCGGCCCUCdTdT | 1172 GAGGGCCGCAUGUGCGUCA | 1380 |
| AD-71082 | UCCACUCGGUAUUGACGCAdTdT | 1173 UGCGUCAAUACCGAGUGGG | 1381 |
| AD-71083 | UCCGAAGGCGCCCCACUCGdTdT | 1174 CGAGUGGGGCGCCUUCGGG | 1382 |
| AD-71084 | UGCCGGAGUCCCCGAAGGCdTdT | 1175 GCCUUCGGGGACUCCGGCG | 1383 |
| AD-71085 | ACUCGUCCAGCUCGCCGGAdTdT | 1176 UCCGGCGAGCUGGACGAGU | 1384 |
| AD-71086 | ACUCCAGCAGGAACUCGUCdTdT | 1177 GACGAGUUCCUGCUGGAGU | 1385 |
| AD-71087 | AGGCGGUCAUACUCCAGCAdTdT | 1178 UGCUGGAGUAUGACCGCCU | 1386 |
| AD-71088 | UCUCGUCCACCAGGCGGUCdTdT | 1179 GACCGCCUGGUGGACGAGA | 1387 |
| AD-71089 | GUUUGCAGAGCUCUCGUCCdTdT | 1180 GGACGAGAGCUCUGCAAAC | 1388 |
| AD-71090 | UCUGACCGGGGUUUGCAGAdTdT | 1181 UCUGCAAACCCCGGUCAGC | 1389 |
| AD-71091 | UCUCAUACAGCUGCUGACCdTdT | 1182 GGUCAGCAGCUGUAUGAGA | 1390 |
| AD-71092 | UACCUAUGAGCUUCUCAUAdTdT | 1183 UAUGAGAAGCUCAUAGGUG | 1391 |
| AD-71093 | AUGUACUUGCCACCUAUGAdTdT | 1184 UCAUAGGUGGCAAGUACAU | 1392 |
| AD-71094 | UCAGCUCGCCCAUGUACUUdTdT | 1185 AAGUACAUGGGCGAGCUGG | 1393 |
| AD-71095 | ACAAGCCGCACCAGCUCGCdTdT | 1186 GCGAGCUGGUGCGGCUUGU | 1394 |
| AD-71096 | AGCCUGAGCAGCACAAGCCdTdT | 1187 GGCUUGUGCUGCUCAGGCU | 1395 |
| AD-71097 | UUUUCGUCCACGAGCCUGAdTdT | 1188 UCAGGCUCGUGGACGAAAA | 1396 |
| AD-69448 | AAGAGCAGGUUUUCGUCCAdTdT | 1189 UGGACGAAAACCUGCUCUU | 1397 |
| AD-71098 | UCCUCCCCGUGGAAGAGCAdTdT | 1190 UGCUCUUCCACGGGAGGC | 1398 |
| AD-71099 | AGCUGCUCGGAGGCCUCCCdTdT | 1191 GGGAGGCCUCCGAGCAGCU | 1399 |
| AD-71100 | UCGUGUGCGCAGCUGCUCGdTdT | 1192 CGAGCAGCUGCGCACACGC | 1400 |
| AD-71101 | UAAGCGCGUCUCGAAGGCUdTdT | 1193 AGCCUUCGAGACGCGCUUC | 1401 |
| AD-71102 | UCACCUGCGACACGAAGCGdTdT | 1194 CGCUUCGUGUCGCAGGUGG | 1402 |
| AD-71103 | UGUCGCUCUCCACCUGCGAdTdT | 1195 UCGCAGGUGGAGAGCGACA | 1403 |

TABLE 7-continued

GCK Modified Sequences

| | | | |
|---|---|---|---|
| AD-71104 | UGCGGUCGCCCGUGUCGCUdTdT | 1196 | AGCGACACGGGCGACCGCA | 1404 |
| AD-71105 | UUAGAUCUGCUUGCGGUCGdTdT | 1197 | CGACCGCAAGCAGAUCUAC | 1405 |
| AD-71106 | UCAGGAUGUUGUAGAUCUGdTdT | 1198 | CAGAUCUACAACAUCCUGA | 1406 |
| AD-71107 | AGCCCCAGCGUGCUCAGGAdTdT | 1199 | UCCUGAGCACGCUGGGCU | 1407 |
| AD-71108 | UCGAGGGUCGCAGCCCCAGdTdT | 1200 | CUGGGGCUGCGACCCUCGA | 1408 |
| AD-71109 | AGUCGGUGGUCGAGGGUCGdTdT | 1201 | CGACCCUCGACCACCGACU | 1409 |
| AD-71110 | UACGAUGUCGCAGUCGGUGdTdT | 1202 | CACCGACUGCGACAUCGUG | 1410 |
| AD-71111 | UCAGGCGCGGCGCACGAUGdTdT | 1203 | CAUCGUGCGCCGCGCCUGC | 1411 |
| AD-71112 | ACACGCUCUCGCAGGCGCGdTdT | 1204 | CGCGCCUGCGAGAGCGUGU | 1412 |
| AD-71113 | UAGCGCGCGUAGACACGCUdTdT | 1205 | AGCGUGUCUACGCGCGCUG | 1413 |
| AD-71114 | AGCACAUGUGCGCAGCGCGdTdT | 1206 | CGCGCUGCGCACAUGUGCU | 1414 |
| AD-71115 | AGCCCCGCCGAGCACAUGUdTdT | 1207 | ACAUGUGCUCGGCGGGGCU | 1415 |
| AD-71116 | AUGACGCCCGCCAGCCCCGdTdT | 1208 | CGGGGCUGGCGGGCGUCAU | 1416 |
| AD-71117 | AUGCGGUUGAUGACGCCCGdTdT | 1209 | CGGGCGUCAUCAACCGCAU | 1417 |
| AD-71118 | UGCUCUCGCGCAUGCGGUUdTdT | 1210 | AACCGCAUGCGCGAGAGCC | 1418 |
| AD-71119 | ACGUCCUCGCUGCGGCUCUdTdT | 1211 | AGAGCCGCAGCGAGGACGU | 1419 |
| AD-71120 | UAUGCGCAUUACGUCCUCGdTdT | 1212 | CGAGGACGUAAUGCGCAUC | 1420 |
| AD-71121 | ACGCCCACAGUGAUGCGCAdTdT | 1213 | UGCGCAUCACUGUGGGCGU | 1421 |
| AD-71122 | ACGGAGCCAUCCACGCCCAdTdT | 1214 | UGGGCGUGGAUGGCUCCGU | 1422 |
| AD-71123 | UAGCUUGUACACGGAGCCAdTdT | 1215 | UGGCUCCGUGUACAAGCUG | 1423 |
| AD-71124 | AGCUGGGGUGCAGCUUGUAdTdT | 1216 | UACAAGCUGCACCCCAGCU | 1424 |
| AD-71125 | AACCGCUCCUUGAAGCUGGdTdT | 1217 | CCAGCUUCAAGGAGCGGUU | 1425 |
| AD-71126 | UUGGCAUGGAACCGCUCCUdTdT | 1218 | AGGAGCGGUUCCAUGCCAG | 1426 |
| AD-71127 | AGCCUGCGCACGCUGGCAUdTdT | 1219 | AUGCCAGCGUGCGCAGGCU | 1427 |
| AD-71128 | AGCUGGGCGUCAGCCUGCGdTdT | 1220 | CGCAGGCUGACGCCCAGCU | 1428 |
| AD-71129 | AGGUGAUCUCGCAGCUGGGdTdT | 1221 | CCCAGCUGCGAGAUCACCU | 1429 |

TABLE 7-continued

GCK Modified Sequences

| | | | |
|---|---|---|---|
| AD-71130 ACUCGAUGAAGGUGAUCUCdTdT | 1222 | GAGAUCACCUUCAUCGAGU | 1430 |
| AD-71131 UGCCCUCCUCCGACUCGAUdTdT | 1223 | AUCGAGUCGGAGGAGGGCA | 1431 |
| AD-71132 UCCCGGCCACUGCCCUCCUdTdT | 1224 | AGGAGGGCAGUGGCCGGGG | 1432 |
| AD-71133 UACCAGGGCCGCGCCCCGGdTdT | 1225 | CCGGGGCGCGGCCCUGGUC | 1433 |
| AD-71134 UCCACCGCCGAGACCAGGGdTdT | 1226 | CCCUGGUCUCGGCGGUGGC | 1434 |
| AD-71135 UCUUCUUACAGGCCACCGCdTdT | 1227 | GCGGUGGCCUGUAAGAAGG | 1435 |
| AD-71136 UAGCAUACAGGCCUUCUUAdTdT | 1228 | UAAGAAGGCCUGUAUGCUG | 1436 |
| AD-71137 UCACUGGCCCAGCAUACAGdTdT | 1229 | CUGUAUGCUGGGCCAGUGA | 1437 |
| AD-71138 UCGGCCACUGCUCUCACUGdTdT | 1230 | CAGUGAGAGCAGUGGCCGC | 1438 |
| AD-71139 UCUGCGCUUGCGGCCACUGdTdT | 1231 | CAGUGGCCGCAAGCGCAGG | 1439 |
| AD-71140 UUGGCAUCCUCCCUGCGCUdTdT | 1232 | AGCGCAGGGAGGAUGCCAC | 1440 |
| AD-71141 UUGCUGUGGGGCUGUGGCAdTdT | 1233 | UGCCACAGCCCCACAGCAC | 1441 |
| AD-71142 AUGGAGCCUGGGUGCUGUGdTdT | 1234 | CACAGCACCCAGGCUCCAU | 1442 |
| AD-71143 UCACUUCCCCAUGGAGCCUdTdT | 1235 | AGGCUCCAUGGGGAAGUGC | 1443 |
| AD-71144 ACGUGUGGGGAGCACUUCCdTdT | 1236 | GGAAGUGCUCCCCACACGU | 1444 |
| AD-71145 AGGCUGCGAGCACGUGUGGdTdT | 1237 | CCACACGUGCUCGCAGCCU | 1445 |
| AD-71146 UUGCCCCGCCAGGCUGCGAdTdT | 1238 | UCGCAGCCUGGCGGGGCAG | 1446 |
| AD-71147 UGCCAGGCCUCCUGCCCCGdTdT | 1239 | CGGGGCAGGAGGCCUGGCC | 1447 |
| AD-71148 UGGUCCUGACAAGGCCAGGdTdT | 1240 | CCUGGCCUUGUCAGGACCC | 1448 |
| AD-71149 UCAGGCGGCCUGGGUCCUGdTdT | 1241 | CAGGACCCAGGCCGCCUGC | 1449 |
| AD-71150 UCAGCGGUAUGGCAGGCGGdTdT | 1242 | CCGCCUGCCAUACCGCUGG | 1450 |
| AD-71151 UCUCUGUUCCCCAGCGGUAdTdT | 1243 | UACCGCUGGGGAACAGAGC | 1451 |
| AD-71152 UGAAGAGGCCCGCUCUGUUdTdT | 1244 | AACAGAGCGGGCCUCUUCC | 1452 |
| AD-71153 UGAAAAACUGAGGGAAGAGdTdT | 1245 | CUCUUCCCUCAGUUUUUCG | 1453 |
| AD-71154 UGGCUGUCCCACCGAAAAAdTdT | 1246 | UUUUUCGGUGGGACAGCCC | 1454 |
| AD-71155 AGGGCCCUGGGGCUGUCCCdTdT | 1247 | GGGACAGCCCCAGGGCCCU | 1455 |

TABLE 7-continued

GCK Modified Sequences

| | | | |
|---|---|---|---|
| AD-71156 UCACCCCCGUUAGGGC CCUdTdT | 1248 | AGGGCCCUAACGGGGG UGC | 1456 |
| AD-71157 UCCUGCUCCUGCCGCAC CCdTdT | 1249 | GGGUGCGGCAGGAGCA GGA | 1457 |
| AD-71158 AGUCUCUGUUCCUGCU CCUdTdT | 1250 | AGGAGCAGGAACAGAG ACU | 1458 |
| AD-71159 UGGGGCUUCCAGAGUC UCUdTdT | 1251 | AGAGACUCUGGAAGCC CCC | 1459 |
| AD-71160 UGAGAAAGGUGGGGGG CUUdTdT | 1252 | AAGCCCCCCACCUUUCU CG | 1460 |
| AD-71161 AAUUGAUUCCAGCGAG AAAdTdT | 1253 | UUUCUCGCUGGAAUCA AUU | 1461 |
| AD-71162 UCCUUCUGGGAAAUUG AUUdTdT | 1254 | AAUCAAUUUCCCAGAA GGG | 1462 |
| AD-71163 UGAGCAACUCCCUUCU GGGdTdT | 1255 | CCCAGAAGGGAGUUGC UCA | 1463 |
| AD-71164 UAAAGUCCUGAGUGAG CAAdTdT | 1256 | UUGCUCACUCAGGACU UUG | 1464 |
| AD-71165 UGAAAUGCAUCAAAGU CCUdTdT | 1257 | AGGACUUUGAUGCAUU UCC | 1465 |
| AD-71166 UCUCUGACAGUGUGGA AAUdTdT | 1258 | AUUUCCACACUGUCAG AGC | 1466 |
| AD-71167 UAGGCCAACAGCUCUG ACAdTdT | 1259 | UGUCAGAGCUGUUGGC CUC | 1467 |
| AD-71168 UGGGCCCAGGCGAGGC CAAdTdT | 1260 | UUGGCCUCGCCUGGGC CCA | 1468 |
| AD-71169 UCCCAGAGCCUGGGCC CAGdTdT | 1261 | CUGGGCCCAGGCUCUG GGA | 1469 |
| AD-71170 AGGGCACCCCUUCCCA GAGdTdT | 1262 | CUCUGGGAAGGGGUGC CCU | 1470 |
| AD-71171 UAGCAGGAUCCAGAGG GCAdTdT | 1263 | UGCCCUCUGGAUCCUG CUG | 1471 |
| AD-71172 AAGUGAGGCCACAGCA GGAdTdT | 1264 | UCCUGCUGUGGCCUCA CUU | 1472 |
| AD-71173 AGUUCCCAGGGAAGUG AGGdTdT | 1265 | CCUCACUUCCCUGGGA ACU | 1473 |
| AD-71174 ACACAGGAUGAGUUCC CAGdTdT | 1266 | CUGGGAACUCAUCCUG UGU | 1474 |
| AD-71175 AGCUGCCUCCCCACACA GGdTdT | 1267 | CCUGUGUGGGGAGGCA GCU | 1475 |
| AD-71176 AGCUGUUGGAGCUGCC UCCdTdT | 1268 | GGAGGCAGCUCCAACA GCU | 1476 |
| AD-71177 AGGUCUGGUCAAGCUG UUGdTdT | 1269 | CAACAGCUUGACCAGA CCU | 1477 |
| AD-71178 UGCCCAGGUCUAGGUC UGGdTdT | 1270 | CCAGACCUAGACCUGG GCC | 1478 |
| AD-71179 UGCUGCCCUUUUGGCC CAGdTdT | 1271 | CUGGGCCAAAAGGGCA GCC | 1479 |
| AD-71180 AGCAGCCCCUGGCUGC CCUdTdT | 1272 | AGGGCAGCCAGGGGCU GCU | 1480 |
| AD-71181 ACUGGGUGAUGAGCAG CCCdTdT | 1273 | GGGCUGCUCAUCACCC AGU | 1481 |

TABLE 7-continued

GCK Modified Sequences

| | | | |
|---|---|---|---|
| AD-71182 | AAAAUGGCCAGGACUGGGUdTdT | 1274 | ACCCAGUCCUGGCCAUUUU | 1482 |
| AD-71183 | UCUCAGGCAAGAAAAUGGCdTdT | 1275 | GCCAUUUUCUUGCCUGAGG | 1483 |
| AD-71184 | UGGCCUCUUGAGCCUCAGGdTdT | 1276 | CCUGAGGCUCAAGAGGCCC | 1484 |
| AD-71185 | AUUGCUCCCUGGGCCUCUUdTdT | 1277 | AAGAGGCCCAGGGAGCAAU | 1485 |
| AD-71186 | AGCCCCCUCCCAUUGCUCCdTdT | 1278 | GGAGCAAUGGGAGGGGCU | 1486 |
| AD-71187 | UUCCUCCAUGGAGCCCCCUdTdT | 1279 | AGGGGGCUCCAUGGAGGAG | 1487 |
| AD-71188 | AGCUUGGGACACCUCCUCCdTdT | 1280 | GGAGGAGGUGUCCCAAGCU | 1488 |
| AD-71189 | UGGUAUUCAAAGCUUGGGAdTdT | 1281 | UCCCAAGCUUUGAAUACCC | 1489 |
| AD-71190 | AAAGGUCUCUGGGGGUAUUdTdT | 1282 | AAUACCCCCAGAGACCUUU | 1490 |
| AD-71191 | UGGGAGAGAAAAGGUCUCUdTdT | 1283 | AGAGACCUUUUCUCUCCCA | 1491 |
| AD-71192 | UCAGUGAUGGUAUGGGAGAdTdT | 1284 | UCUCCCAUACCAUCACUGA | 1492 |
| AD-71193 | AUCACAAGCCACUCAGUGAdTdT | 1285 | UCACUGAGUGGCUUGUGAU | 1493 |
| AD-71194 | UAUCCCAGAAUCACAAGCCdTdT | 1286 | GGCUUGUGAUUCUGGGAUG | 1494 |
| AD-71195 | UCUGCGAGGGUCCAUCCCAdTdT | 1287 | UGGGAUGGACCCUCGCAGC | 1495 |
| AD-71196 | UCUCUUGCACCUGCUGCGAdTdT | 1288 | UCGCAGCAGGUGCAAGAGA | 1496 |
| AD-71197 | UGGGGCUCUGUCUCUUGCAdTdT | 1289 | UGCAAGAGACAGAGCCCCC | 1497 |
| AD-71198 | UCAGAGGCUUGGGGGCUCUdTdT | 1290 | AGAGCCCCCAAGCCUCUGC | 1498 |
| AD-71199 | UGGGCCCCUUGGGGCAGAGdTdT | 1291 | CUCUGCCCCAAGGGGCCCA | 1499 |
| AD-71200 | UCCCCUUUGUGGGCCCCUUdTdT | 1292 | AAGGGGCCCACAAAGGGGA | 1500 |
| AD-71201 | UCUGGCCCUUCUCCCCUUUdTdT | 1293 | AAAGGGGAGAAGGGCCAGC | 1501 |
| AD-71202 | UAAGAUGUAGGGCUGGCCCdTdT | 1294 | GGGCCAGCCCUACAUCUUC | 1502 |
| AD-71203 | UGCUAUGGGAGCUGAAGAUdTdT | 1295 | AUCUUCAGCUCCCAUAGCG | 1503 |
| AD-71204 | UUGAGCCAGCGCUAUGGGAdTdT | 1296 | UCCCAUAGCGCUGGCUCAG | 1504 |

TABLE 7-continued

GCK Modified Sequences

| | | |
|---|---|---|
| AD-71205 UGGGUUUCUUCCUGAGCCAdTdT | 1297 UGGCUCAGGAAGAAACCCC | 1505 |
| AD-71206 UUGAAUGCUGCUUGGGGUUdTdT | 1298 AACCCCAAGCAGCAUUCAG | 1506 |
| AD-71207 UGGGGUGUGCUGAAUGCUGdTdT | 1299 CAGCAUUCAGCACACCCCA | 1507 |
| AD-71208 UGGGUUGUCCCUUGGGGUGdTdT | 1300 CACCCCAAGGGACAACCCC | 1508 |
| AD-71209 UGUCAUAUGAUGGGGUUGUdTdT | 1301 ACAACCCCAUCAUAUGACA | 1509 |
| AD-71210 UGUUGGGCAUGGAGAGGGUdTdT | 1302 ACCCUCUCCAUGCCCAACC | 1510 |
| AD-71211 UACAAUCUUAGGUUGGGCAdTdT | 1303 UGCCCAACCUAAGAUUGUG | 1511 |
| AD-71212 AAAAAACCCACACAAUCUUdTdT | 1304 AAGAUUGUGUGGGUUUUUU | 1512 |
| AD-71213 AACAUUUUUAAUUAAAAAAdTdT | 1305 UUUUUUAAUUAAAAAUGUU | 1513 |
| AD-71214 AAAACUUUUAACAUUUUUAdTdT | 1306 UAAAAAUGUUAAAAGUUUU | 1514 |
| AD-71215 UUUUCAUGUUUAAAACUUUdTdT | 1307 AAAGUUUUAAACAUGAAAA | 1515 |

TABLE 8

GCK Single Dose Screen in Primary Cynomolgus Hepatocytes

| DuplexID | 20nM_AVG | 20nM_STDEV |
|---|---|---|
| AD-71009 | 91.7 | 8.2 |
| AD-71010 | 85.5 | 11.8 |
| AD-71011 | 101.4 | 19.6 |
| AD-71012 | 96.3 | 20.8 |
| AD-71013 | 102.8 | 21.7 |
| AD-71014 | 105.3 | 47.3 |
| AD-71015 | 32.6 | 6.6 |
| AD-71016 | 98.7 | 19.1 |
| AD-71017 | 64.1 | 16.4 |
| AD-71018 | 45.9 | 12.8 |
| AD-71019 | 39.6 | 8.5 |
| AD-71020 | 89.2 | 23.9 |
| AD-71021 | 60.4 | 7.7 |
| AD-71022 | 100.8 | 12.7 |
| AD-71023 | 97.4 | 33 |
| AD-71024 | 60.6 | 18.8 |
| AD-71025 | 31.1 | 9 |
| AD-71026 | 33.6 | 10.5 |
| AD-71027 | 46.3 | 14.6 |
| AD-71028 | 35.6 | 9.6 |
| AD-71029 | 35.6 | 15.9 |
| AD-71030 | 30.4 | 7.9 |
| AD-71031 | 107.2 | 29 |
| AD-71032 | 78.4 | 15.7 |
| AD-71033 | 71.8 | 13.9 |
| AD-71034 | 39.7 | 14.3 |
| AD-71035 | 46.8 | 11.4 |
| AD-71036 | 77.6 | 21.3 |
| AD-71037 | 37.4 | 15.2 |
| AD-71038 | 48.8 | 19.6 |
| AD-71039 | 70.1 | 9.5 |
| AD-71040 | 65.9 | 16.2 |
| AD-71041 | 94.8 | 18.6 |
| AD-71042 | 108.4 | 24.2 |
| AD-71043 | 35.8 | 12.2 |
| AD-71044 | 46.6 | 10.9 |
| AD-71045 | 39.4 | 9.5 |
| AD-71046 | 35.3 | 3.9 |
| AD-71047 | 82 | 24.4 |
| AD-71048 | 39.8 | 10.1 |
| AD-71049 | 95.3 | 6.8 |
| AD-71050 | 151.2 | 22.4 |
| AD-71051 | 54 | 13.5 |
| AD-71052 | 48.7 | 8.1 |
| AD-71053 | 44 | 10.7 |
| AD-71054 | 53.4 | 8.8 |
| AD-71055 | 39.8 | 9.4 |
| AD-71056 | 51.8 | 34 |
| AD-71057 | 71 | 7.1 |
| AD-71058 | 38.9 | 3.6 |
| AD-71059 | 78.1 | 17.8 |
| AD-71060 | 54 | 14.4 |
| AD-71061 | 108.4 | 27.2 |
| AD-71062 | 69.4 | 6.7 |
| AD-71063 | 35.1 | 11 |
| AD-71064 | 53.1 | 13.8 |
| AD-71065 | 94 | 11.6 |
| AD-71066 | 149.2 | 13.3 |
| AD-71067 | 50.8 | 15.2 |
| AD-71068 | 113.4 | 23.7 |
| AD-71069 | 44.9 | 6.4 |
| AD-71070 | 112.3 | 24.3 |
| AD-71071 | 32.7 | 5.3 |
| AD-71072 | 40.1 | 10.2 |
| AD-71073 | 53 | 12.5 |
| AD-71074 | 135.4 | 25.3 |
| AD-71075 | 100.8 | 31.5 |
| AD-71076 | 35.6 | 7.3 |
| AD-71077 | 26.9 | 4.7 |
| AD-71078 | 54.4 | 11.8 |
| AD-71079 | 48 | 6.2 |
| AD-71080 | 96.1 | 6 |

TABLE 8-continued

GCK Single Dose Screen in Primary *Cynomolgus* Hepatocytes

| DuplexID | 20nM_AVG | 20nM_STDEV |
|---|---|---|
| AD-71081 | 105.4 | 7.9 |
| AD-71082 | 127 | 20 |
| AD-71083 | 117.2 | 33.2 |
| AD-71084 | 124.4 | 20.7 |
| AD-71085 | 78.5 | 6.6 |
| AD-71086 | 30.2 | 12.7 |
| AD-71087 | 44.2 | 2 |
| AD-71088 | 92.9 | 21.9 |
| AD-71089 | 36.1 | 13.7 |
| AD-71090 | 40 | 3.6 |
| AD-71091 | 58 | 3.3 |
| AD-71092 | 62.3 | 14.9 |
| AD-71093 | 58.6 | 18.2 |
| AD-71094 | 82.7 | 22.9 |
| AD-71095 | 116.8 | 27.6 |
| AD-71096 | 40.3 | 11.8 |
| AD-71097 | 26.6 | 6.9 |
| AD-69448 | 34.9 | 9.3 |
| AD-71098 | 50.4 | 7.4 |
| AD-71099 | 50.7 | 18.4 |
| AD-71100 | 23.8 | 1.7 |
| AD-71101 | 70.7 | 18.1 |
| AD-71102 | 37.2 | 5.5 |
| AD-71103 | 98.3 | 17.6 |
| AD-71104 | 78.8 | 22.8 |
| AD-71105 | 29.6 | 6.1 |
| AD-71106 | 26.1 | 8.1 |
| AD-71107 | 54.4 | 9.2 |
| AD-71108 | 143.2 | 28.5 |
| AD-71109 | 116.6 | 15.9 |
| AD-71110 | 107.3 | 21.5 |
| AD-71111 | 36.8 | 9 |
| AD-71112 | 76.4 | 19.7 |
| AD-71113 | 71.7 | 12.9 |
| AD-71114 | 94.8 | 22.5 |
| AD-71115 | 43.3 | 12.3 |
| AD-71116 | 58.7 | 7.9 |
| AD-71117 | 26.9 | 7.1 |
| AD-71118 | 74 | 15.8 |
| AD-71119 | 33.8 | 12.9 |
| AD-71120 | 30.5 | 4.3 |
| AD-71121 | 51.8 | 7.6 |
| AD-71122 | 71.8 | 20.4 |
| AD-71123 | 45.6 | 12.4 |
| AD-71124 | 156.4 | 6.6 |
| AD-71125 | 55.4 | 6.2 |
| AD-71126 | 102.3 | 8.5 |
| AD-71127 | 107.8 | 18.2 |
| AD-71128 | 95.6 | 19 |
| AD-71129 | 51.6 | 16.7 |
| AD-71130 | 28.4 | 10.3 |
| AD-71131 | 49 | 6.5 |
| AD-71132 | 127.7 | 25.6 |
| AD-71133 | 157.5 | 17.4 |
| AD-71134 | 38 | 11.1 |
| AD-71135 | 62.6 | 7.6 |
| AD-71136 | 141.6 | 20.3 |
| AD-71137 | 55.9 | 6.4 |
| AD-71138 | 37.9 | 5 |
| AD-71139 | 125.8 | 27.6 |
| AD-71140 | 41.8 | 2.5 |
| AD-71141 | 32.8 | 6.7 |
| AD-71142 | 40.4 | 11.5 |
| AD-71143 | 177.4 | 27.3 |
| AD-71144 | 53.5 | 9.1 |
| AD-71145 | 41.3 | 27 |
| AD-71146 | 105.9 | 13.9 |
| AD-71147 | 98.2 | 27.5 |
| AD-71148 | 73.6 | 8.9 |
| AD-71149 | 159 | 24.3 |
| AD-71150 | 157.9 | 31.1 |
| AD-71151 | 131.4 | 4.3 |
| AD-71152 | 98.2 | 25.2 |
| AD-71153 | 66.6 | 23 |
| AD-71154 | 134.8 | 11.9 |
| AD-71155 | 52.8 | 4.2 |
| AD-71156 | 111.4 | 43.9 |
| AD-71157 | 37.6 | 7.7 |
| AD-71158 | 83.3 | 16.9 |
| AD-71159 | 33.7 | 7.3 |
| AD-71160 | 44.2 | 7.2 |
| AD-71161 | 159.1 | 28.3 |
| AD-71162 | 137.2 | 20.9 |
| AD-71163 | 23.4 | 5.4 |
| AD-71164 | 27.7 | 2.6 |
| AD-71165 | 38.1 | 8 |
| AD-71166 | 46.4 | 11.4 |
| AD-71167 | 53.1 | 17.6 |
| AD-71168 | 130.3 | 14 |
| AD-71169 | 95.8 | 24.4 |
| AD-71170 | 108.8 | 15.4 |
| AD-71171 | 57.6 | 5.3 |
| AD-71172 | 75 | 26.8 |
| AD-71173 | 87.3 | 24 |
| AD-71174 | 62.7 | 24.2 |
| AD-71175 | 83.6 | 25.8 |
| AD-71176 | 26.7 | 3.5 |
| AD-71177 | 31 | 4.7 |
| AD-71178 | 114.6 | 20 |
| AD-71179 | 101.9 | 25.9 |
| AD-71180 | 114 | 12.4 |
| AD-71181 | 38.2 | 10.1 |
| AD-71182 | 32.3 | 3.2 |
| AD-71183 | 49.9 | 7.4 |
| AD-71184 | 60.6 | 6.7 |
| AD-71185 | 30 | 3 |
| AD-71186 | 55.7 | 16.3 |
| AD-71187 | 72.8 | 15.2 |
| AD-71188 | 32.1 | 2.2 |
| AD-71189 | 76.4 | 13.9 |
| AD-71190 | 34.2 | 9.1 |
| AD-71191 | 51.7 | 9.5 |
| AD-71192 | 87.5 | 8.3 |
| AD-71193 | 110.2 | 20.9 |
| AD-71194 | 56.9 | 12.6 |
| AD-71195 | 63.1 | 25.2 |
| AD-71196 | 38.1 | 10.3 |
| AD-71197 | 34 | 9.8 |
| AD-71198 | 108.1 | 12 |
| AD-71199 | 117.9 | 11.5 |
| AD-71200 | 50.1 | 12.3 |
| AD-71201 | 38.2 | 5.8 |
| AD-71202 | 73.9 | 3.6 |
| AD-71203 | 110.3 | 9.2 |
| AD-71204 | 140 | 11 |
| AD-71205 | 35.8 | 4.5 |
| AD-71206 | 28 | 12.1 |
| AD-71207 | 22.4 | 11 |
| AD-71208 | 54.6 | 10.9 |
| AD-71209 | 40.6 | 14.9 |
| AD-71210 | 41.5 | 6.3 |
| AD-71211 | 54.4 | 16 |
| AD-71212 | 122.4 | 20.7 |
| AD-71213 | 111.4 | 13.7 |
| AD-71214 | 120.1 | 19.5 |
| AD-71215 | 98 | 11.7 |

SEQUENCE LISTING (1515 sequences)

SEQ ID NO: 1 - DNA, 2442 bp, Homo sapiens
cctttcagtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatgaaaaaaaa

SEQ ID NO: 2 - DNA, 2741 bp, Homo sapiens
gagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatgaaaaaaaa

SEQ ID NO: 3 - DNA, 2566 bp, Homo sapiens
cctttcagtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatgaaaaaaaa

SEQ ID NO: 4 - DNA, 2438 bp, Macaca fascicularis
cctttcagtgcagaagccctgggctgccagcctcaggcagctctccatccaggcagccattgctgccacagcgggggccttatgctccaaggctacagcatgtgctaggcctcggcaggcaggagcatctctgcttcccaaagcatctacctcttagtccctcggagagatggcgatggatgccacaaggagccaggcccagacagccttgactctggtagagcagatcctggcggagttccagctgcaggaggaggacctgaagaaggtgatgagacggatgcagaaggagatggaccgtggcctgaggttggagacccatgaagaggccagtgtgaagatgctgcccacctacgtgcgctccaccccagaaggctcagaagtcggggacttcctctccctggacctgggtggcaccaacttcagggtgatgctggtgaaggtgggagaaggtgaggaggggcagtggagcgtgaagaccaaacaccagatgtactccatccccgaggacgccatgaccggcactgctgagatgctcttcgactacatctccgagtgcatctccgacttcctggacaagcatcagatgaagcacaagaagctgcccctgggcttcaccttctcctttcctgtgaggcatgaagacatcgataagggcatccttctcaactggaccaagggcttcaaggcctcaggagcagaagggaacaatgtcgtggggcttctgcgagatgccatcaaacggagaggggacttcgaaatggatgtggtggcaatggtgaatgacacggtggccacgatgatctcctgctactacgaagaccatcagtgcgaggtcggcatgattgtgggcacgggctgcaacgcctgctacatggaggagatgcagaatgtggagctggtggagggggacgagggccgcatgtgcgtcaacaccgaatggggcgccttcggggactcgggcgagctggacgagttcctgctggagtatgaccgcctggtggacgagagctctgcaaaccccggtcagcagctgtatgagaagctcataggtggcaagtacatgggcgagctggtgcggctcgtgctgctcaggctcgtggacgaaaacctgctcttccacggggaggcctccgagcagctgcgcacacgcggagccttcgagacacgcttcgtgtcgcaggtggagagcgacacgggcgaccgcaagcagatctacaacatcctgagcacgctggggctacgaccctcggccactgactgcgacatcgtgcgccgcgcctgcgagagcgtgtctacgcgcgctgcacacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccacgctagcgtgcgcaggctgacgcccagctgcgagatcaccttcatcgagtcggaggagggcagtggccggggcgcggccctggtctcggcggtggcctgtaagaaggcctgcatgctgggccagtgagagcagtgaccgccagcacagggaggatgccacagccccacagcacccaggctccacggggaagtgctccccacacgtgctcgcagcctggcggggcaggagacctggccttgtcaggacctgggctgcctgccatcccgctggggaacccagcgggcctcttccctcagtcattcggtgggacagccctagggccctaactggggtgcggcaggagcagggacagagactctggaagcccccacctttctcactggaatcaccttcctagaagggagttgctcactcaggactttgttgcatttccacactgtcagagctgttggcctcgcctgggcccaggctctgggaagggggcgccctctggatcctgctgtggcctctcttccctgggaactcatcctgtgtggggaggcagctccaacagcttgaccagacctacacctgggccaaaagggcagccaggggctgctcatcacccagtcctggccattttcttgcttgaggctcaagaggcccagggagcaatgggagagggctccatggaggaggtgtcccaagctgcaaatacccccagagaccttttctctcctgtacccccatccctgagtgacttgtgattctgggatggaccctcacagcaggtgcaagagacagagcccccaagcccctgccccaaggggcccacaaaggggagaagggccagccctgcattttcaactcccacagcactggctcaggaagaaaccccaagcagcattcagcacaccccaagggaccaccccatcatacgacatgccaccctctccatgcccaacctgagactgtgtgagttttttaattaaaaatgttaaaagttttaaacatg

SEQ ID NO: 5 - DNA, 3460 bp, Macaca fascicularis
gggccgtgagtgggaaatacacaccagacctccgtatcttaggcagaagtacattttgttccagactattgtctgagcctgccgctaagttggctccagcaccctggccccctgctccatccactcactgggcctccctactgcacagggcaacctctctaggggtgcttgggctgcgagggagagagtgggtggcatcccaggcagaagcttcttgagcaggtccagaggaggagccagtccctgtgggcctctgttctggcagtttcaaactcagccaggcttgtgtgggccaggtttactgttctggttcagatttcaagacaataatcaggacaggccacaccaaagccctccgatggtcccatgggcctgcgcttgagccacaccgagctgcctgctccctttcctctgcttccagactcacggggtcctctgctcctcggaacaggagtgtgggagaccctgagacactgccccaggacctgaacaggtggcaaaggcttaacaggctagcagtcacttcagtgacaaggtgattgagtggtcaccatggtgatggggatggaggctctttgccaccagtcccagttttatgcatggcagctctaatgacagcacggtcagccctgctgagtccacttctggtcaccatgacaaccacaggccctctcaggagcacagtaagccctggcaggagaatcccccactccacacctggttggagcaggaaatgccgagcggcgcctgagccccggggaagcaggctagggcgtgagagacacagtcacctgcagcttaattactcaaaagctgtccccaggccacaggagggagaggacctttcctactgagtctgtctgaaggacactaagtcccacagctcaacagaacctggagagaaagcgctaaggacgccacctgagcgccaagcgatggccctgcctggagaacatccaggctcagtgaggaagggtccagaagggaatgcttgccgactcgctggagaacaatgaaaaggaggaaactgtgactgaacctcaaaccccaaactagcctgaggaggaccacattctcccggggacccagggcgggccgtgacccctgcaggggagaagccttggacatttctgcttcagaagcctgttggggaaggctgaggggtcccagctccctgcgctggctgctgtgcagatgctggacgacagagccaggatggaggccgccaagaaggagaaggtagagcagatcctggcggagttccagctgcaggaggaggacctgaagaaggtgatgagacggatgcagaaggagatggaccgtggcctgaggttggagacccatgaagaggccagtgtgaagatgctgcccacctacgtgcgctccaccccagaaggctcagaagtcggggacttcctctccctggacctgggtggcaccaacttcagggtgatgctggtgaaggtgggagaaggtgaggaggggcagtggagcgtgaagaccaaacaccagatgtactccatccccgaggacgccatgaccggcactgctgagatgctcttcgactacatctccgagtgcatctccgacttcctggacaagcatcagatgaagcacaagaagctgcccctgggcttcaccttctcctttcctgtgaggcatgaagacatcgataagggcatccttctcaactggaccaagggcttcaaggcctcaggagcagaagggaacaatgtcgtggggcttctgcgagatgccatcaaacggagaggggacttcgaaatggatgtggtggcaatggtgaatgacacggtggccacgatgatctcctgctactacgaagaccatcagtgcgaggtcggcatgattgtgggcacgggctgcaacgcctgctacatggaggagatgcagaatgtggagctggtggagggggacgagggccgcatgtgcgtcaacaccgaatggggcgccttcggggactcgggcgagctggacgagttcctgctggagtatgaccgcctggtggacgagagctctgcaaaccccggtcagcagctgtatgagaagctcataggtggcaagtacatgggcgagctggtgcggctcgtgctgctcaggctcgtggacgaaaacctgctcttccacggggaggcctccgagcagctgcgcacacgcggagccttcgagacacgcttcgtgtcgcaggtggagagcgacacgggcgaccgcaagcagatctacaacatcctgagcacgctggggctacgaccctcggccactgactgcgacatcgtgcgccgcgcctgcgagagcgtgtctacgcgcgctgcacacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccacgctagcgtgcgcaggctgacgcccagctgcgagatcaccttcatcgagtcggaggagggcagtggccggggcgcggccctggtctcggcggtggcctgtaagaaggcctgcatgctgggccagtgagagcagtgaccgccagcacagggaggatgccacagccccacagcacccaggctccacggggaagtgctccccacacgtgctcgcagcctggcggggcaggagacctggccttgtcaggacctgggctgcctgccatcccgctggggaacccagcgggcctcttccctcagtcattcggtgggacagccctagggccctaactggggtgcggcaggagcagggacagagactctggaagcccccacctttctcactggaatcaccttcctagaagggagttgctcactcaggactttgttgcatttccacactgtcagagctgttggcctcgcctgggcccaggctctgggaagggggcgccctctggatcctgctgtggcctctcttccctgggaactcatcctgtgtggggaggcagctccaacagcttgaccagacctacacctgggccaaaagggcagccaggggctgctcatcacccagtcctggccattttcttgcttgaggctcaagaggcccagggagcaatgggagagggctccatggaggaggtgtcccaagctgcaaatacccccagagaccttttctctcctgtacccccatccctgagtgacttgtgattctgggatggaccctcacagcaggtgcaagagacagagcccccaagcccctgccccaaggggcccacaaaggggagaagggccagccctgcattttcaactcccacagcactggctcaggaagaaaccccaagcagcattcagcacaccccaagggaccaccccatcatacgacatgccaccctctccatgcccaacctgagactgtgtgagttttttaattaaaaatgttaaaagttttaaacatg

SEQ ID NO: 6 - DNA, 1481 bp, Macaca fascicularis
cctttcagtgcagaagccctgggctgccagcctcaggcagctctccatccaggcagccattgctgccacagcgggggccttatgctccaaggctacagcatgtgctaggcctcggcaggcaggagcatctctgcttcccaaagcatctacctcttagtccctcggagagatggcgatggatgccacaaggagccaggcccagacagccttgactctggtagagcagatcctggcggagttccagctgcaggaggaggacctgaagaaggtgatgagacggatgcagaaggagatggaccgtggcctgaggttggagacccatgaagaggccagtgtgaagatgctgcccacctacgtgcgctccaccccagaaggctcagaagtcggggacttcctctccctggacctgggtggcaccaacttcagggtgatgctggtgaaggtgggagaaggtgaggaggggcagtggagcgtgaagaccaaacaccagatgtactccatccccgaggacgccatgaccggcactgctgagatgctcttcgactacatctccgagtgcatctccgacttcctggacaagcatcagatgaagcacaagaagctgcccctgggcttcaccttctcctttcctgtgaggcatgaagacatcgataagggcatccttctcaactggaccaagggcttcaaggcctcaggagcagaagggaacaatgtcgtggggcttctgcgagatgccatcaaacggagaggggacttcgaaatggatgtggtggcaatggtgaatgacacggtggccacgatgatctcctgctactacgaagaccatcagtgcgaggtcggcatgattgtgggcacgggctgcaacgcctgctacatggaggagatgcagaatgtggagctggtggagggggacgagggccgcatgtgcgtcaacaccgaatggggcgccttcggggactcgggcgagctggacgagttcctgctggagtatgaccgcctggtggacgagagctctgcaaaccccggtcagcagctgtatgagaagctcataggtggcaagtacatgggcgagctggtgcggctcgtgctgctcaggctcgtggacgaaaacctgctcttccacggggaggcctccgagcagctgcgcacacgcggagccttcgagacacgcttcgtgtcgcaggtggagagcgacacgggcgaccgcaagcagatctacaacatcctgagcacgctggggctacgaccctcggccactgactgcgacatcgtgcgccgcgcctgcgagagcgtgtctacgcgcgctgcacacatgtgctcggcggggctggcgggcgtcatcaaccgcatgcgcgagagccgcagcgaggacgtaatgcgcatcactgtgggcgtggatggctccgtgtacaagctgcaccccaggtgataagcctgagacataaaggaggctgggccctgccaccacgatagcagccaca

SEQ ID NO: 7 - DNA, 2282 bp, Macaca fascicularis
cctttcagtgcagaagccctgggctgccagcctcaggcagctctccatccaggcagccattgctgccacagcgggggccttatgctccaaggctacagcatgtgctaggcctcggcaggcaggagcatctctgcttcccaaagcatctacctcttagtccctcggagagatggcgatggatgccacaaggagccaggcccagacagccttgactctggtagagcagatcctggcggagttccagctgcaggaggaggacctgaagaaggtgatgagacggatgcagaaggagatggaccgtggcctgaggttggagacccatgaagaggccagtgtgaagatgctgcccacctacgtgcgctccaccccagaaggctcagaagtcggggacttcctctccctggacctgggtggcaccaacttcagggtgatgctggtgaaggtgggagaaggtgaggaggggcagtggagcgtgaagaccaaacaccagatgtactccatccccgaggacgccatgaccggcactgctgagatgctcttcgactacatctccgagtgcatctccgacttcctggacaagcatcagatgaagcacaagaagctgcccctgggcttcaccttctcctttcctgtgaggcatgaagacatcgataagggcatccttctcaactggaccaagggcttcaaggcctcaggagcagaagggaacaatgtcgtggggcttctgcgagatgccatcaaacggagaggggacttcgaaatggatgtggtggcaatggtgaatgacacggtggccacgatgatctcctgctactacgaagaccatcagtgcgaggtcggcatgattgtgggcacgggctgcaacgcctgctacatggaggagatgcagaatgtggagctggtggagggggacgagggccgcatgtgcgtcaacaccgaatggggcgccttcggggactcgggcgagctggacgagttcctgctggagtatgaccgcctggtggacgagagctctgcaaaccccggtcagcagctcgacacgggcgaccgcaagcagatctacaacatcctgagcacgctggggctacgaccctcggccactgactgcgacatcgtgcgccgcgcctgcgagagcgtgtctacgcgcgctgcacacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccacgctagcgtgcgcaggctgacgcccagctgcgagatcaccttcatcgagtcggaggagggcagtggccggggcgcggccctggtctcggcggtggcctgtaagaaggcctgcatgctgggccagtgagagcagtgaccgccagcacagggaggatgccacagccccacagcacccaggctccacggggaagtgctccccacacgtgctcgcagcctggcggggcaggagacctggccttgtcaggacctgggctgcctgccatcccgctggggaacccagcgggcctcttccctcagtcattcggtgggacagccctagggccctaactggggtgcggcaggagcagggacagagactctggaagcccccacctttctcactggaatcaccttcctagaagggagttgctcactcaggactttgttgcatttccacactgtcagagctgttggcctcgcctgggcccaggctctgggaagggggcgccctctggatcctgctgtggcctctcttccctgggaactcatcctgtgtggggaggcagctccaacagcttgaccagacctacacctgggccaaaagggcagccaggggctgctcatcacccagtcctggccattttcttgcttgaggctcaagaggcccagggagcaatgggagagggctccatggaggaggtgtcccaagctgcaaatacccccagagaccttttctctcctgtacccccatccctgagtgacttgtgattctgggatggaccctcacagcaggtgcaagagacagagcccccaagcccctgccccaaggggcccacaaaggggagaagggccagccctgcattttcaactcccacagcactggctcaggaagaaaccccaagcagcattcagcacaccccaagggaccaccccatcatacgacatgccaccctctccatgcccaacctgagactgtgtgagttttttaattaaaaatgttaaaagttttaaacatg

SEQ ID NO: 8 - DNA, 2727 bp, Mus musculus
caggagcacagaggccctgacaggagacatctactccacacctggttggaacagaagcaccgactgtgactgagcccagagaagaaagctgaggcgtgagggacagagagttacctgttgcctcattactcaaaagccatccccaagccactggagggagagaccttttgtgctgagtccgtctagaggccaccagttcctcacagctcagcagagctggaagaaagtcagtcaacactgaggaaccacatggctcctcctgaagaccgctgggcctgaagaggccttggtggggaggggtccagaagtgaacaatgaaaaagaggaagctgtggcttcaaccagcctgaggtggacggcagagctctctgaggtccggggctggctgtgactctgtgggggaagtctgggctacttctgctttggaaagctgctgcggaacactgaggggtcccagctcacctgggctggcggctgggcagatgctggatgacagagccaggatggaggccaccaagaaggaaaaggtagagcagatcctggcagagttccagctgcaggaggaagacctgaagaaggtgatgagccggatgcagaaggagatggaccgtggcctgaagctggagacccatcaggaggccagtgtaaagatgttgcccacctacgtgcgttccaccccagaaggctcagaagttggagactttctctccttagacctgggaggaaccaacttcagggtgatgctggtgaaagtgggggagggggaggcaggacagtggagcgtgaagacgaaacaccagatgtattccatccccgaggacgccatgacgggcactgcggagatgctctttgactacatctctgagtgcatctctgacttcctggacaagcatcagatgaaacacaagaaactacccctgggcttcaccttctccttccctgtaaggcacgaagacatagacaagggcatcctgctcaactggaccaagggcttcaaggcctccggagcagaagggaacaacatcgtgggacttctccgagatgctatcaagaggagaggggactttgagatggatgtggtggcaatggtgaatgacacggtggccacaatgatctcctgctactatgaagaccgccaatgtgaggtcggcatgattgtgggcaccggctgcaacgcctgctacatggaggagatgcagaatgtggagctggtggaaggcgatgaggggcgcatgtgtgtcaacacagagtggggcgccttcgggaactccggtgagctggacgagttcctcctggagtacgaccggatggtggatgagagctcagtgaaccccggtcagcagctgtacgaaaagatcattggcggaaagtacatgggcgagctggtacgacttgtgctgctcaagctggtagaggagaatcttctgttccacggagaggcctcagagcagctgcgcacacgtggtgcttttgagacccgttttgtgtcgcaggtggagagcgactctggggaccgaaggcagatccttaacatcctgagcactctgggccttcgaccctctgtcgccgactgcgacattgtgcgccgtgcctgtgaaagcgtgtccactcgcgccgcccacatgtgctcagcaggactagcgggggtcataaatcgcatgcgcgaaagccgcagtgaggacgtgatgcgcatcacggtgggcgtggatggctccgtgtacaagctgcacccgagcttcaaggagcggtttcacgccagtgtgcgcaggctgacacccaactgcgaaatcaccttcattgaatcagaggagggcagcggcaggggagccgcactggtctctgcggtggcctgcaagaaggcttgcatgctgggccagtgaaatccaggcaaggacagggacctgggttccacggggactccacaccccacaaatgctcccagtccactagggcaggagacctattctgctgctacccctggaaaatggggagaggcccctgcaagccaagtcagccagtgagacagccctagggctctcagcctggggcaaggggcaagaggatcagcggcaccaaaagcctttcttgctagaatcaactacagagaaaggtgaagcacactcaggtcttgctctttcagcttctggcctcccacagctgtgggtctggcctcccaagggagtgcctcctggacttgcaatggcctggcttccctgggaacacatctccatggggaggtagcttcagcagcttggccagaccagacctgggcccccagaagagtaagggctgcccagacctggctgttttcttgcctgtggctgaagaggctgcaaaaccatgggagaccgactatctagctacatggaggggactttccaggccacaaacattccagagacagtctccttcatatacctccacccctgagtggcttacagttctgggatgaaccctcctaggagatgccagaggatagaggcccagagtccttgctctaggggacctgaaggggagcgcctcactctgcactgttagcaggatggcagcttcaacactcacatcagtgatccgggaagagaagcaagccacccacagcatctctccaggaaaccacccaggtccctctgtccctcatccctgtcaggtttcccagatgccatgccgccctctccacaccagcttggaaccatgggggagtttttaattaaatatttaaaactactt

SEQ ID NO: 9 - DNA, 2372 bp, Mus musculus
ttagtgcagaagtccttggctgcctgtcttttgcaacactcagccagacagtcctcacccacagcaggtggcctcgggagtcaggaacatctctacttccccaacgacccctgcttatcctcagatggctgtggatactacaaggaggggagcccagtcgttgactctggtagagcagatcctggcagagttccagctgcaggaggaagacctgaagaaggtgatgagccggatgcagaaggagatggaccgtggcctgaagctggagacccatcaggaggccagtgtaaagatgttgcccacctacgtgcgttccaccccagaaggctcagaagttggagactttctctccttagacctgggaggaaccaacttcagggtgatgctggtgaaagtgggggagggggaggcaggacagtggagcgtgaagacgaaacaccagatgtattccatccccgaggacgccatgacgggcactgcggagatgctctttgactacatctctgagtgcatctctgacttcctggacaagcatcagatgaaacacaagaaactacccctgggcttcaccttctccttccctgtaaggcacgaagacatagacaagggcatcctgctcaactggaccaagggcttcaaggcctccggagcagaagggaacaacatcgtgggacttctccgagatgctatcaagaggagaggggactttgagatggatgtggtggcaatggtgaatgacacggtggccacaatgatctcctgctactatgaagaccgccaatgtgaggtcggcatgattgtgggcaccggctgcaacgcctgctacatggaggagatgcagaatgtggagctggtggaaggcgatgaggggcgcatgtgtgtcaacacagagtggggcgccttcgggaactccggtgagctggacgagttcctcctggagtacgaccggatggtggatgagagctcagtgaaccccggtcagcagctgtacgaaaagatcattggcggaaagtacatgggcgagctggtacgacttgtgctgctcaagctggtagaggagaatcttctgttccacggagaggcctcagagcagctgcgcacacgtggtgcttttgagacccgttttgtgtcgcaggtggagagcgactctggggaccgaaggcagatccttaacatcctgagcactctgggccttcgaccctctgtcgccgactgcgacattgtgcgccgtgcctgtgaaagcgtgtccactcgcgccgcccacatgtgctcagcaggactagcgggggtcataaatcgcatgcgcgaaagccgcagtgaggacgtgatgcgcatcacggtgggcgtggatggctccgtgtacaagctgcacccgagcttcaaggagcggtttcacgccagtgtgcgcaggctgacacccaactgcgaaatcaccttcattgaatcagaggagggcagcggcaggggagccgcactggtctctgcggtggcctgcaagaaggcttgcatgctgggccagtgaaatccaggcaaggacagggacctgggttccacggggactccacaccccacaaatgctcccagtccactagggcaggagacctattctgctgctacccctggaaaatggggagaggcccctgcaagccaagtcagccagtgagacagccctagggctctcagcctggggcaaggggcaagaggatcagcggcaccaaaagcctttcttgctagaatcaactacagagaaaggtgaagcacactcaggtcttgctctttcagcttctggcctcccacagctgtgggtctggcctcccaagggagtgcctcctggacttgcaatggcctggcttccctgggaacacatctccatggggaggtagcttcagcagcttggccagaccagacctgggcccccagaagagtaagggctgcccagacctggctgttttcttgcctgtggctgaagaggctgcaaaaccatgggagaccgactatctagctacatggaggggactttccaggccacaaacattccagagacagtctccttcatatacctccacccctgagtggcttacagttctgggatgaaccctcctaggagatgccagaggatagaggcccagagtccttgctctaggggacctgaaggggagcgcctcactctgcactgttagcaggatggcagcttcaacactcacatcagtgatccgggaagagaagcaagccacccacagcatctctccaggaaaccacccaggtccctctgtccctcatccctgtcaggtttcccagatgccatgccgccctctccacaccagcttggaaccatgggggagtttttaattaaatatttaaaactacttaaa

SEQ ID NO: 10 - DNA, 2343 bp, Rattus norvegicus
gcctatcttttgcaacactcagccagacagtcctcacctgcaacaggtggcctcaggagtcaggaacatctctacttccccaacgacccctgggttgtcctctcagagatggctatggatactacaaggtgtggagcccagttgttgactctggtcgagcagatcctggcagagttccagctgcaggaggaagacctgaagaaggtgatgagccggatgcagaaggagatggaccgtggcctgaggctggagacccacgaggaggccagtgtaaagatgttacccacctacgtgcgttccaccccagaaggctcagaagtcggagactttctctccttagacctgggaggaaccaacttcagagtgatgctggtcaaagtgggagagggggaggcagggcagtggagcgtgaagacaaaacaccagatgtactccatccccgaggacgccatgacgggcactgccgagatgctctttgactacatctctgaatgcatctctgacttccttgacaagcatcagatgaagcacaagaaactgcccctgggcttcaccttctccttccctgtgaggcacgaagacctagacaagggcatcctcctcaattggaccaagggcttcaaggcctctggagcagaagggaacaacatcgtaggacttctccgagatgctatcaagaggagaggggactttgagatggatgtggtggcaatggtgaacgacacagtggccacaatgatctcctgctactatgaagaccgccaatgtgaggtcggcatgattgtgggcactggctgcaatgcctgctacatggaggaaatgcagaatgtggagctggtggaaggggatgagggacgcatgtgcgtcaacacggagtggggcgccttcggggactcgggcgagctggatgagttcctactggagtatgaccggatggtggatgaaagctcagcgaaccccggtcagcagctgtacgagaagatcatcggtgggaagtatatgggcgagctggtacgacttgtgctgcttaagctggtggacgagaaccttctgttccacggagaggcctcggagcagctgcgcacgcgtggtgcttttgagacccgtttcgtgtcacaagtggagagcgactccggggaccgaaagcagatccacaacatcctaagcactctggggcttcgaccctctgtcaccgactgcgacattgtgcgccgtgcctgtgaaagcgtgtccactcgcgccgcccatatgtgctccgcaggactagctggggtcataaatcgcatgcgcgaaagccgcagtgaggacgtgatgcgcatcactgtgggcgtggatggctccgtgtacaagctgcacccgagcttcaaggagcggtttcacgccagtgtgcgcaggctgacacccaactgcgaaatcaccttcatcgaatcagaggagggcagcggcaggggagccgcgctggtctctgcggtggcctgcaagaaggcttgcatgctggcccagtgaaatccaggtcatatggaccgggacctgggttccacggggactccacacaccacaaatgctcccagcccaccggggcaggagacctattctgctgctacccctggaaaatggggagaggcccctgcaagccgagtcggccagtgggacagccctagggctctcagcctggggcagggggctgggaggaagaagaggatcagaggcgccaaggcctttcttgctagaatcaactacagaaaatggcggaaaatactcaggacttgcactttcacgattcttgcttcccaagcgtgggtctggcctcccaagggaatgcttcctggaccttgcaatggcctggcttccctgggggggacacaccttcatggggaggtaacttcagcagttcggccagaccagaccccaggagagtaagggctgctagtcacccagacctggctgttttcttgtctgtggctgaagaggccggggagccatgagagactgactatccggctacatggagaggactttccaggcatgaacatgccagagactgttgccttcatatacctccacccgagtggcttacagttctgggatgaaccctcccaggagatgccagaggttagagccccagagtccttgctctaaggggaccagaaaggggaggcctcactctgcactattcaagcaggaatcatctccaacactcaggtccctgacccaggaggaagaagccaccctcagtgtccctccaagagaccacccaggtccttctctccctcgttcccaaatgccagcctctctacctgggactgtgggggagtttttaattaaatatttaaaactacttca

SEQ ID NO: 11 - DNA, 2442 bp, Rattus norvegicus
gcctatcttttgcaacactcagccagacagtcctcacctgcaacaggtggcctcaggagtcaggaacatctctacttccccaacgacccctgggttgtcctctcagagatggctatggatactacaaggtgtggagcccagttgttgactctgggcaccaacaaatgcacgaatgcatgctccctgctgtgcagagcgggtactcacaacgggcacatgaaccctcgctgccgaacagagcaggcggccgccacacagctgcccacctgcagagtccagctactcttgaactatcatgtggagggtcgagcagatcctggcagagttccagctgcaggaggaagacctgaagaaggtgatgagccggatgcagaaggagatggaccgtggcctgaggctggagacccacgaggagaagtcggagactttctctccttagacctgggaggaaccaacttcagagtgatgctggtcaaagtgggagagggggaggcagggcagtggagcgtgaagacaaaacaccagatgtactccatccccgaggacgccatgacgggcactgccgagatgctctttgactacatctctgaatgcatctctgacttccttgacaagcatcagatgaagcacaagaaactgcccctgggcttcaccttctccttccctgtgaggcacgaagacctagacaagggcatcctcctcaattggaccaagggcttcaaggcctctggagcagaagggaacaacatcgtaggacttctccgagatgctatcaagaggagaggggactttgagatggatgtggtggcaatggtgaacgacacagtggccacaatgatctcctgctactatgaagaccgccaatgtgaggtcggcatgattgtgggcactggctgcaatgcctgctacatggaggaaatgcagaatgtggagctggtggaaggggatgagggacgcatgtgcgtcaacacggagtggggcgccttcggggactcgggcgagctggatgagttcctactggagtatgaccggatggtggatgaaagctcagcgaaccccggtcagcagctgtacgagaagatcatcggtgggaagtatatgggcgagctggtacgacttgtgctgcttaagctggtggacgagaaccttctgttccacggagaggcctcggagcagctgcgcacgcgtggtgcttttgagacccgtttcgtgtcacaagtggagagcgactccggggaccgaaagcagatccacaacatcctaagcactctggggcttcgaccctctgtcaccgactgcgacattgtgcgccgtgcctgtgaaagcgtgtccactcgcgccgcccatatgtgctccgcaggactagctggggtcataaatcgcatgcgcgaaagccgcagtgaggacgtgatgcgcatcactgtgggcgtggatggctccgtgtacaagctgcacccgagcttcaaggagcggtttcacgccagtgtgcgcaggctgacacccaactgcgaaatcaccttcatcgaatcagaggagggcagcggcaggggagccgcgctggtctctgcggtggcctgcaagaaggcttgcatgctggcccagtgaaatccaggtcatatggaccgggacctgggttccacggggactccacacaccacaaatgctcccagcccaccggggcaggagacctattctgctgctacccctggaaaatggggagaggcccctgcaagccgagtcggccagtgggacagccctagggctctcagcctggggcagggggctgggaggaagaagaggatcagaggcgccaaggcctttcttgctagaatcaactacagaaaatggcggaaaatactcaggacttgcactttcacgattcttgcttcccaagcgtgggtctggcctcccaagggaatgcttcctggaccttgcaatggcctggcttccctgggggggacacaccttcatggggaggtaacttcagcagttcggccagaccagaccccaggagagtaagggctgctagtcacccagacctggctgttttcttgtctgtggctgaagaggccggggagccatgagagactgactatccggctacatggagaggactttccaggcatgaacatgccagagactgttgccttcatatacctccacccgagtggcttacagttctgggatgaaccctcccaggagatgccagaggttagagccccagagtccttgctctaaggggaccagaaaggggaggcctcactctgcactattcaagcaggaatcatctccaacactcaggtccctgacccaggaggaagaagccaccctcagtgtccctccaagagaccacccaggtccttctctccctcgttcccaaatgccagcctctctacctgggactgtgggggagtttttaattaaatatttaaaactacttca

SEQ ID NO: 12 - DNA, 2220 bp, Rattus norvegicus
gggggtcccagttcacctgggctggtggctgcgcagatgctggatgacagagccaggatggaggccaccaagaaggaaaaggtcgagcagatcctggcagagttccagctgcaggaggaagacctgaagaaggtgatgagccggatgcagaaggagatggaccgtggcctgaggctggagacccacgaggaggccagtgtaaagatgttacccacctacgtgcgttccaccccagaaggctcagaagtcggagactttctctccttagacctgggaggaaccaacttcagagtgatgctggtcaaagtgggagagggggaggcagggcagtggagcgtgaagacaaaacaccagatgtactccatccccgaggacgccatgacgggcactgccgagatgatgaagcacaagaaactgcccctgggcttcaccttctccttccctgtgaggcacgaagacctagacaagggcatcctcctcaattggaccaagggcttcaaggcctctggagcagaagggaacaacatcgtaggacttctccgagatgctatcaagaggagaggggactttgagatggatgtggtggcaatggtgaacgacacagtggccacaatgatctcctgctactatgaagaccgccaatgtgaggtcggcatgattgtgggcactggctgcaatgcctgctacatggaggaaatgcagaatgtggagctggtggaaggggatgagggacgcatgtgcgtcaacacggagtggggcgccttcggggactcgggcgagctggatgagttcctactggagtatgaccggatggtggatgaaagctcagcgaaccccggtcagcagctgtacgagaagatcatcggtgggaagtatatgggcgagctggtacgacttgtgctgcttaagctggtggacgagaaccttctgttccacggagaggcctcggagcagctgcgcacgcgtggtgcttttgagacccgtttcgtgtcacaagtggagagcgactccggggaccgaaagcagatccacaacatcctaagcactctggggcttcgaccctctgtcaccgactgcgacattgtgcgccgtgcctgtgaaagcgtgtccactcgcgccgcccatatgtgctccgcaggactagctggggtcataaatcgcatgcgcgaaagccgcagtgaggacgtgatgcgcatcactgtgggcgtggatggctccgtgtacaagctgcacccgagcttcaaggagcggtttcacgccagtgtgcgcaggctgacacccaactgcgaaatcaccttcatcgaatcagaggagggcagcggcaggggagccgcgctggtctctgcggtggcctgcaagaaggcttgcatgctggcccagtgaaatccaggtcatatggaccgggacctgggttccacggggactccacacaccacaaatgctcccagcccaccggggcaggagacctattctgctgctacccctggaaaatggggagaggcccctgcaagccgagtcggccagtgggacagccctagggctctcagcctggggcagggggctgggaggaagaagaggatcagaggcgccaaggcctttcttgctagaatcaactacagaaaatggcggaaaatactcaggacttgcactttcacgattcttgcttcccaagcgtgggtctggcctcccaagggaatgcttcctggaccttgcaatggcctggcttccctgggggggacacaccttcatggggaggtaacttcagcagttcggccagaccagaccccaggagagtaagggctgctagtcacccagacctggctgttttcttgtctgtggctgaagaggccggggagccatgagagactgactatccggctacatggagaggactttccaggcatgaacatgccagagactgttgccttcatatacctccacccgagtggcttacagttctgggatgaaccctcccaggagatgccagaggttagagccccagagtccttgctctaaggggaccagaaaggggaggcctcactctgcactattcaagcaggaatcatctccaacactcaggtccctgacccaggaggaagaagccaccctcagtgtccctccaagagaccacccaggtccttctctccctcgttcccaaatgccagcctctctacctgggactgtgggggagtttttaattaaatatttaaaactacttca

SEQ ID NO: 13 - DNA, 2442 bp, Homo sapiens
ttttttttcatgtttaaaacttttaacatttttaattaaaaaacccacacaatcttaggttgggcatggagagggtggcatgtcatatgatggggttgtcccttggggtgtgctgaatgctgcttggggtttcttcctgagccagcgctatgggagctgaagatgtagggctggcccttctcccctttgtgggccccttggggcagaggcttgggggctctgtctcttgcacctgctgcgagggtccatcccagaatcacaagccactcagtgatggtatgggagagaaaaggtctctgggggtattcaaagcttgggacacctcctccatggagccccctcccattgctccctgggcctcttgagcctcaggcaagaaaatggccaggactgggtgatgagcagcccctggctgcccttttggcccaggtctaggtctggtcaagctgttggagctgcctccccacacaggatgagttcccagggaagtgaggccacagcaggatccagagggcaccccttcccagagcctgggcccaggcgaggccaacagctctgacagtgtggaaatgcatcaaagtcctgagtgagcaactcccttctgggaaattgattccagcgagaaaggtggggggcttccagagtctctgttcctgctcctgccgcacccccgttagggccctggggctgtcccaccgaaaaactgagggaagaggcccgctctgttccccagcggtatggcaggcggcctgggtcctgacaaggccaggcctcctgccccgccaggctgcgagcacgtgtggggagcacttccccatggagcctgggtgctgtggggctgtggcatcctccctgcgcttgcggccactgctctcactggcccagcatacaggccttcttacaggccaccgccgagaccagggccgcgccccggccactgccctcctccgactcgatgaaggtgatctcgcagctgggcgtcagcctgcgcacgctggcatggaaccgctccttgaagctggggtgcagcttgtacacggagccatccacgcccacagtgatgcgcattacgtcctcgctgcggctctcgcgcatgcggttgatgacgcccgccagccccgccgagcacatgtgcgcagcgcgcgtagacacgctctcgcaggcgcggcgcacgatgtcgcagtcggtggtcgagggtcgcagccccagcgtgctcaggatgttgtagatctgcttgcggtcgcccgtgtcgctctccacctgcgacacgaagcgcgtctcgaaggctccgcgtgtgcgcagctgctcggaggcctccccgtggaagagcaggttttcgtccacgagcctgagcagcacaagccgcaccagctcgcccatgtacttgccacctatgagcttctcatacagctgctgaccggggtttgcagagctctcgtccaccaggcggtcatactccagcaggaactcgtccagctcgccggagtccccgaaggcgccccactcggtattgacgcacatgcggccctcgtccccctccaccagctccacattctgcatctcctccatgtagcaggcattgcagcccgtgcccacgatcatgccgacctcgcactgatggtcttcgtagtagcaggagatcatcgtggccaccgtgtcattcaccattgccaccacatccatttcaaagtcccctctccgtttgatagcgtctcgcagaagccccacgacattgttcccttctgctcctgaggccttgaagcccttggtccagttgagaaggatgcccttatcgatgtcttcgtgcctcacaggaaaggagaaggtgaagcccaggggcagcttcttgtgtttcatctgatgcttgtccaggaagtcggagatgcactcagagatgtagtcgaagagcatctcagcagtgccggtcatggcgtcctcggggatggagtacatctggtgtttggtcttcacgctccactgcccctcctcaccttctcccaccttcaccagcatcaccctgaagttagtgccacccaggtccagggagaggaagtccccgacttctgagccttctggggtggagcgcacgtaggtgggcagcatcttcacactggcctcttcatgggtctccagcctcaggccgcggtccatctccttctgcatccgtctcatcaccttcttcaggtcctcctcctgcagctggaactctgccaggatctgctctaccagagtcaaggctgtctgggcctggctccttgtgacatccatcgccatctctccgaggggctaagaggtagatgctttgggaggcagagatgctcctgcctgctgaggcctagcacatgctgtagccttggagcgtaaggcccgcctgtggcagcaacggctgcttggatggagagctgcctgaggctggcagcccagggcttctgcactgaaagg

SEQ ID NO: 14 - DNA, 2741 bp, Homo sapiens
ttttttttcatgtttaaaacttttaacatttttaattaaaaaacccacacaatcttaggttgggcatggagagggtggcatgtcatatgatggggttgtcccttggggtgtgctgaatgctgcttggggtttcttcctgagccagcgctatgggagctgaagatgtagggctggcccttctcccctttgtgggccccttggggcagaggcttgggggctctgtctcttgcacctgctgcgagggtccatcccagaatcacaagccactcagtgatggtatgggagagaaaaggtctctgggggtattcaaagcttgggacacctcctccatggagccccctcccattgctccctgggcctcttgagcctcaggcaagaaaatggccaggactgggtgatgagcagcccctggctgcccttttggcccaggtctaggtctggtcaagctgttggagctgcctccccacacaggatgagttcccagggaagtgaggccacagcaggatccagagggcaccccttcccagagcctgggcccaggcgaggccaacagctctgacagtgtggaaatgcatcaaagtcctgagtgagcaactcccttctgggaaattgattccagcgagaaaggtggggggcttccagagtctctgttcctgctcctgccgcacccccgttagggccctggggctgtcccaccgaaaaactgagggaagaggcccgctctgttccccagcggtatggcaggcggcctgggtcctgacaaggccaggcctcctgccccgccaggctgcgagcacgtgtggggagcacttccccatggagcctgggtgctgtggggctgtggcatcctccctgcgcttgcggccactgctctcactggcccagcatacaggccttcttacaggccaccgccgagaccagggccgcgccccggccactgccctcctccgactcgatgaaggtgatctcgcagctgggcgtcagcctgcgcacgctggcatggaaccgctccttgaagctggggtgcagcttgtacacggagccatccacgcccacagtgatgcgcattacgtcctcgctgcggctctcgcgcatgcggttgatgacgcccgccagccccgccgagcacatgtgcgcagcgcgcgtagacacgctctcgcaggcgcggcgcacgatgtcgcagtcggtggtcgagggtcgcagccccagcgtgctcaggatgttgtagatctgcttgcggtcgcccgtgtcgctctccacctgcgacacgaagcgcgtctcgaaggctccgcgtgtgcgcagctgctcggaggcctccccgtggaagagcaggttttcgtccacgagcctgagcagcacaagccgcaccagctcgcccatgtacttgccacctatgagcttctcatacagctgctgaccggggtttgcagagctctcgtccaccaggcggtcatactccagcaggaactcgtccagctcgccggagtccccgaaggcgccccactcggtattgacgcacatgcggccctcgtccccctccaccagctccacattctgcatctcctccatgtagcaggcattgcagcccgtgcccacgatcatgccgacctcgcactgatggtcttcgtagtagcaggagatcatcgtggccaccgtgtcattcaccattgccaccacatccatttcaaagtcccctctccgtttgatagcgtctcgcagaagccccacgacattgttcccttctgctcctgaggccttgaagcccttggtccagttgagaaggatgcccttatcgatgtcttcgtgcctcacaggaaaggagaaggtgaagcccaggggcagcttcttgtgtttcatctgatgcttgtccaggaagtcggagatgcactcagagatgtagtcgaagagcatctcagcagtgccggtcatggcgtcctcggggatggagtacatctggtgtttggtcttcacgctccactgcccctcctcaccttctcccaccttcaccagcatcaccctgaagttagtgccacccaggtccagggagaggaagtccccgacttctgagccttctggggtggagcgcacgtaggtgggcagcatcttcacactggcctcttcatgggtctccagcctcaggccgcggtccatctccttctgcatccgtctcatcaccttcttcaggtcctcctcctgcagctggaactctgccaggatctgctctaccttctccttcttggcggcctccatcctggctctgtcgtccagcatctgcacagcagccagcgtggggagctgggacccctcagccttccccagtaggcttctgaagtggaaatatccaaggcttctccgccgcaggggtcacggcccgccctgggtccctgggagaatgtggttctcctcgggctggtttggggtttgaggttcagtcacagtttcctccttttcattgttctccaacgagtcggcaagcattcccttctggacccttcctcactgagcctggatgttctccaggcagggccattgctgggcgcttgggtggcgtcctcagcgctttctctcctggttgtgttgagctgtggggcttagtgtccttcagacagattcagtgggaaatgtcctctcccttctgtgacctggggacagcttttgagtaattaggctgcaggtgactgtgtctctcacatcctagcctgcttccctggggctcaggcgccgctcggcatttcctgctc

SEQ ID NO: 15 - DNA, 2566 bp, Homo sapiens
ttttttttcatgtttaaaacttttaacatttttaattaaaaaacccacacaatcttaggttgggcatggagagggtggcatgtcatatgatggggttgtcccttggggtgtgctgaatgctgcttggggtttcttcctgagccagcgctatgggagctgaagatgtagggctggcccttctcccctttgtgggccccttggggcagaggcttgggggctctgtctcttgcacctgctgcgagggtccatcccagaatcacaagccactcagtgatggtatgggagagaaaaggtctctgggggtattcaaagcttgggacacctcctccatggagccccctcccattgctccctgggcctcttgagcctcaggcaagaaaatggccaggactgggtgatgagcagcccctggctgcccttttggcccaggtctaggtctggtcaagctgttggagctgcctccccacacaggatgagttcccagggaagtgaggccacagcaggatccagagggcaccccttcccagagcctgggcccaggcgaggccaacagctctgacagtgtggaaatgcatcaaagtcctgagtgagcaactcccttctgggaaattgattccagcgagaaaggtggggggcttccagagtctctgttcctgctcctgccgcacccccgttagggccctggggctgtcccaccgaaaaactgagggaagaggcccgctctgttccccagcggtatggcaggcggcctgggtcctgacaaggccaggcctcctgccccgccaggctgcgagcacgtgtggggagcacttccccatggagcctgggtgctgtggggctgtggcatcctccctgcgcttgcggccactgctctcactggcccagcatacaggccttcttacaggccaccgccgagaccagggccgcgccccggccactgccctcctccgactcgatgaaggtgatctcgcagctgggcgtcagcctgcgcacgctggcatggaaccgctccttgaagctggggtgcagcttgtacacggagccatccacgcccacagtgatgcgcattacgtcctcgctgcggctctcgcgcatgcggttgatgacgcccgccagccccgccgagcacatgtgcgcagcgcgcgtagacacgctctcgcaggcgcggcgcacgatgtcgcagtcggtggtcgagggtcgcagccccagcgtgctcaggatgttgtagatctgcttgcggtcgcccgtgtcgctctccacctgcgacacgaagcgcgtctcgaaggctccgcgtgtgcgcagctgctcggaggcctccccgtggaagagcaggttttcgtccacgagcctgagcagcacaagccgcaccagctcgcccatgtacttgccacctatgagcttctcatacagctgctgaccggggtttgcagagctctcgtccaccaggcggtcatactccagcaggaactcgtccagctcgccggagtccccgaaggcgccccactcggtattgacgcacatgcggccctcgtccccctccaccagctccacattctgcatctcctccatgtagcaggcattgcagcccgtgcccacgatcatgccgacctcgcactgatggtcttcgtagtagcaggagatcatcgtggccaccgtgtcattcaccattgccaccacatccatttcaaagtcccctctccgtttgatagcgtctcgcagaagccccacgacattgttcccttctgctcctgaggccttgaagcccttggtccagttgagaaggatgcccttatcgatgtcttcgtgcctcacaggaaaggagaaggtgaagcccaggggcagcttcttgtgtttcatctgatgcttgtccaggaagtcggagatgcactcagagatgtagtcgaagagcatctcagcagtgccggtcatggcgtcctcggggatggagtacatctggtgtttggtcttcacgctccactgcccctcctcaccttctcccaccttcaccagcatcaccctgaagttagtgccacccaggtccagggagaggaagtccccgacttctgagccttctggggtggagcgcacgtaggtgggcagcatcttcacactggcctcttcatgggtctccagcctcaggccgcggtccatctccttctgcatccgtctcatcaccttcttcaggtcctcctcctgcagctggaactctgccaggatctgctctacctgggagttgggttgtgggagttgggatcttggtctgggcatgttaacacatctgccagccaaggggcgatttgttccaagtagcagttggccatgtgaggcccgagttcagaggagagtctggcagagtcaaggctgtctgggcctggctccttgtgacatccatcgccatctctccgaggggctaagaggtagatgctttgggaggcagagatgctcctgcctgctgaggcctagcacatgctgtagccttggagcgtaaggcccgcctgtggcagcaacggctgcttggatggagagctgcctgaggctggcagcccagggcttctgcactgaaagg

SEQ ID NO: 16 - DNA, 2438 bp, Macaca fascicularis
catgtttaaaacttttaacatttttaattaaaaaactcacacagtctcaggttgggcatggagagggtggcatgtcgtatgatggggtggtcccttggggtgtgctgaatgctgcttggggtttcttcctgagccagtgctgtgggagttgaaaatgcagggctggcccttctcccctttgtgggccccttggggcaggggcttgggggctctgtctcttgcacctgctgtgagggtccatcccagaatcacaagtcactcagggatgggggtacaggagagaaaaggtctctgggggtatttgcagcttgggacacctcctccatggagccctctcccattgctccctgggcctcttgagcctcaagcaagaaaatggccaggactgggtgatgagcagcccctggctgcccttttggcccaggtgtaggtctggtcaagctgttggagctgcctccccacacaggatgagttcccagggaagagaggccacagcaggatccagagggcgcccccttcccagagcctgggcccaggcgaggccaacagctctgacagtgtggaaatgcaacaaagtcctgagtgagcaactcccttctaggaaggtgattccagtgagaaaggtgggggcttccagagtctctgtccctgctcctgccgcaccccagttagggccctagggctgtcccaccgaatgactgagggaagaggcccgctgggttccccagcgggatggcaggcagcccaggtcctgacaaggccaggtctcctgccccgccaggctgcgagcacgtgtggggagcacttccccgtggagcctgggtgctgtggggctgtggcatcctccctgtgctggcggtcactgctctcactggcccagcatgcaggccttcttacaggccaccgccgagaccagggccgcgccccggccactgccctcctccgactcgatgaaggtgatctcgcagctgggcgtcagcctgcgcacgctagcgtggaaccgctccttgaagctggggtgcagcttgtacacggagccatccacgcccacagtgatgcgcattacgtcctcgctgcggctctcgcgcatgcggttgatgacgcccgccagccccgccgagcacatgtgtgcagcgcgcgtagacacgctctcgcaggcgcggcgcacgatgtcgcagtcagtggccgagggtcgtagccccagcgtgctcaggatgttgtagatctgcttgcggtcgcccgtgtcgctctccacctgcgacacgaagcgtgtctcgaaggctccgcgtgtgcgcagctgctcggaggcctccccgtggaagagcaggttttcgtccacgagcctgagcagcacgagccgcaccagctcgcccatgtacttgccacctatgagcttctcatacagctgctgaccggggtttgcagagctctcgtccaccaggcggtcatactccagcaggaactcgtccagctcgcccgagtccccgaaggcgccccattcggtgttgacgcacatgcggccctcgtccccctccaccagctccacattctgcatctcctccatgtagcaggcgttgcagcccgtgcccacaatcatgccgacctcgcactgatggtcttcgtagtagcaggagatcatcgtggccaccgtgtcattcaccattgccaccacatccatttcgaagtcccctctccgtttgatggcatctcgcagaagccccacgacattgttcccttctgctcctgaggccttgaagcccttggtccagttgagaaggatgcccttatcgatgtcttcatgcctcacaggaaaggagaaggtgaagcccaggggcagcttcttgtgcttcatctgatgcttgtccaggaagtcggagatgcactcggagatgtagtcgaagagcatctcagcagtgccggtcatggcgtcctcggggatggagtacatctggtgtttggtcttcacgctccactgcccctcctcaccttctcccaccttcaccagcatcaccctgaagttggtgccacccaggtccagggagaggaagtccccgacttctgagccttctggggtggagcgcacgtaggtgggcagcatcttcacactggcctcttcatgggtctccaacctcaggccacggtccatctccttctgcatccgtctcatcaccttcttcaggtcctcctcctgcagctggaactccgccaggatctgctctaccagagtcaaggctgtctgggcctggctccttgtggcatccatcgccatctctccgagggactaagaggtagatgctttgggaagcagagatgctcctgcctgccgaggcctagcacatgctgtagccttggagcataaggcccccgctgtggcagcaatggctgcctggatggagagctgcctgaggctggcagcccagggcttctgcactgaaagg

SEQ ID NO: 17 - DNA, 3460 bp, Macaca fascicularis
catgtttaaaacttttaacatttttaattaaaaaactcacacagtctcaggttgggcatggagagggtggcatgtcgtatgatggggtggtcccttggggtgtgctgaatgctgcttggggtttcttcctgagccagtgctgtgggagttgaaaatgcagggctggcccttctcccctttgtgggccccttggggcaggggcttgggggctctgtctcttgcacctgctgtgagggtccatcccagaatcacaagtcactcagggatgggggtacaggagagaaaaggtctctgggggtatttgcagcttgggacacctcctccatggagccctctcccattgctccctgggcctcttgagcctcaagcaagaaaatggccaggactgggtgatgagcagcccctggctgcccttttggcccaggtgtaggtctggtcaagctgttggagctgcctccccacacaggatgagttcccagggaagagaggccacagcaggatccagagggcgcccccttcccagagcctgggcccaggcgaggccaacagctctgacagtgtggaaatgcaacaaagtcctgagtgagcaactcccttctaggaaggtgattccagtgagaaaggtgggggcttccagagtctctgtccctgctcctgccgcaccccagttagggccctagggctgtcccaccgaatgactgagggaagaggcccgctgggttccccagcgggatggcaggcagcccaggtcctgacaaggccaggtctcctgccccgccaggctgcgagcacgtgtggggagcacttccccgtggagcctgggtgctgtggggctgtggcatcctccctgtgctggcggtcactgctctcactggcccagcatgcaggccttcttacaggccaccgccgagaccagggccgcgccccggccactgccctcctccgactcgatgaaggtgatctcgcagctgggcgtcagcctgcgcacgctagcgtggaaccgctccttgaagctggggtgcagcttgtacacggagccatccacgcccacagtgatgcgcattacgtcctcgctgcggctctcgcgcatgcggttgatgacgcccgccagccccgccgagcacatgtgtgcagcgcgcgtagacacgctctcgcaggcgcggcgcacgatgtcgcagtcagtggccgagggtcgtagccccagcgtgctcaggatgttgtagatctgcttgcggtcgcccgtgtcgctctccacctgcgacacgaagcgtgtctcgaaggctccgcgtgtgcgcagctgctcggaggcctccccgtggaagagcaggttttcgtccacgagcctgagcagcacgagccgcaccagctcgcccatgtacttgccacctatgagcttctcatacagctgctgaccggggtttgcagagctctcgtccaccaggcggtcatactccagcaggaactcgtccagctcgcccgagtccccgaaggcgccccattcggtgttgacgcacatgcggccctcgtccccctccaccagctccacattctgcatctcctccatgtagcaggcgttgcagcccgtgcccacaatcatgccgacctcgcactgatggtcttcgtagtagcaggagatcatcgtggccaccgtgtcattcaccattgccaccacatccatttcgaagtcccctctccgtttgatggcatctcgcagaagccccacgacattgttcccttctgctcctgaggccttgaagcccttggtccagttgagaaggatgcccttatcgatgtcttcatgcctcacaggaaaggagaaggtgaagcccaggggcagcttcttgtgcttcatctgatgcttgtccaggaagtcggagatgcactcggagatgtagtcgaagagcatctcagcagtgccggtcatggcgtcctcggggatggagtacatctggtgtttggtcttcacgctccactgcccctcctcaccttctcccaccttcaccagcatcaccctgaagttggtgccacccaggtccagggagaggaagtccccgacttctgagccttctggggtggagcgcacgtaggtgggcagcatcttcacactggcctcttcatgggtctccaacctcaggccacggtccatctccttctgcatccgtctcatcaccttcttcaggtcctcctcctgcagctggaactccgccaggatctgctctaccttctccttcttggcggcctccatcctggctctgtcgtccagcatctgcacagcagccagcgcagggagctgggacccctcagccttccccaacaggcttctgaagcagaaatgtccaaggcttctcccctgcaggggtcacggcccgccctgggtccccgggagaatgtggtcctcctcaggctagtttggggtttgaggttcagtcacagtttcctccttttcattgttctccagcgagtcggcaagcattcccttctggacccttcctcactgagcctggatgttctccaggcagggccatcgcttggcgctcaggtggcgtccttagcgctttctctccaggttctgttgagctgtgggacttagtgtccttcagacagactcagtaggaaaggtcctctccctcctgtggcctggggacagcttttgagtaattaagctgcaggtgactgtgtctctcacgccctagcctgcttccccggggctcaggcgccgctcggcatttcctgctccaaccaggtgtggagtgggggattctcctgccagggcttactgtgctcctgagagggcctgtggttgtcatggtgaccagaagtggactcagcagggctgaccgtgctgtcattagagctgccatgcataaaactgggactggtggcaaagagcctccatccccatcaccatggtgaccactcaatcaccttgtcactgaagtgactgctagcctgttaagcctttgccacctgttcaggtcctggggcagtgtctcagggtctcccacactcctgttccgaggagcagaggaccccgtgagtctggaagcagaggaaagggagcaggcagctcggtgtggctcaagcgcaggcccatgggaccatcggagggctttggtgtggcctgtcctgattattgtcttgaaatctgaaccagaacagtaaacctggcccacacaagcctggctgagtttgaaactgccagaacagaggcccacagggactggctcctcctctggacctgctcaagaagcttctgcctgggatgccacccactctctccctcgcagcccaagcacccctagagaggttgccctgtgcagtagggaggcccagtgagtggatggagcagggggccagggtgctggagccaacttagcggcaggctcagacaatagtctggaacaaaatgtacttctgcctaagatacggaggtctggtgtgtatttcccactcacggccc

SEQ ID NO: 18 - DNA, 1481 bp, Macaca fascicularis
tgtggctgctatcgtggtggcagggcccagcctcctttatgtctcaggcttatcacctggggtgcagcttgtacacggagccatccacgcccacagtgatgcgcattacgtcctcgctgcggctctcgcgcatgcggttgatgacgcccgccagccccgccgagcacatgtgtgcagcgcgcgtagacacgctctcgcaggcgcggcgcacgatgtcgcagtcagtggccgagggtcgtagccccagcgtgctcaggatgttgtagatctgcttgcggtcgcccgtgtcgctctccacctgcgacacgaagcgtgtctcgaaggctccgcgtgtgcgcagctgctcggaggcctccccgtggaagagcaggttttcgtccacgagcctgagcagcacgagccgcaccagctcgcccatgtacttgccacctatgagcttctcatacagctgctgaccggggtttgcagagctctcgtccaccaggcggtcatactccagcaggaactcgtccagctcgcccgagtccccgaaggcgccccattcggtgttgacgcacatgcggccctcgtccccctccaccagctccacattctgcatctcctccatgtagcaggcgttgcagcccgtgcccacaatcatgccgacctcgcactgatggtcttcgtagtagcaggagatcatcgtggccaccgtgtcattcaccattgccaccacatccatttcgaagtcccctctccgtttgatggcatctcgcagaagccccacgacattgttcccttctgctcctgaggccttgaagcccttggtccagttgagaaggatgcccttatcgatgtcttcatgcctcacaggaaaggagaaggtgaagcccaggggcagcttcttgtgcttcatctgatgcttgtccaggaagtcggagatgcactcggagatgtagtcgaagagcatctcagcagtgccggtcatggcgtcctcggggatggagtacatctggtgtttggtcttcacgctccactgcccctcctcaccttctcccaccttcaccagcatcaccctgaagttggtgccacccaggtccagggagaggaagtccccgacttctgagccttctggggtggagcgcacgtaggtgggcagcatcttcacactggcctcttcatgggtctccaacctcaggccacggtccatctccttctgcatccgtctcatcaccttcttcaggtcctcctcctgcagctggaactccgccaggatctgctctaccagagtcaaggctgtctgggcctggctccttgtggcatccatcgccatctctccgagggactaagaggtagatgctttgggaagcagagatgctcctgcctgccgaggcctagcacatgctgtagccttggagcataaggcccccgctgtggcagcaatggctgcctggatggagagctgcctgaggctggcagcccagggcttctgcactgaaagg

SEQ ID NO: 19 - DNA, 2282 bp, Macaca fascicularis
catgtttaaaacttttaacatttttaattaaaaaactcacacagtctcaggttgggcatggagagggtggcatgtcgtatgatggggtggtcccttggggtgtgctgaatgctgcttggggtttcttcctgagccagtgctgtgggagttgaaaatgcagggctggcccttctcccctttgtgggccccttggggcaggggcttgggggctctgtctcttgcacctgctgtgagggtccatcccagaatcacaagtcactcagggatgggggtacaggagagaaaaggtctctgggggtatttgcagcttgggacacctcctccatggagccctctcccattgctccctgggcctcttgagcctcaagcaagaaaatggccaggactgggtgatgagcagcccctggctgcccttttggcccaggtgtaggtctggtcaagctgttggagctgcctccccacacaggatgagttcccagggaagagaggccacagcaggatccagagggcgcccccttcccagagcctgggcccaggcgaggccaacagctctgacagtgtggaaatgcaacaaagtcctgagtgagcaactcccttctaggaaggtgattccagtgagaaaggtgggggcttccagagtctctgtccctgctcctgccgcaccccagttagggccctagggctgtcccaccgaatgactgagggaagaggcccgctgggttccccagcgggatggcaggcagcccaggtcctgacaaggccaggtctcctgccccgccaggctgcgagcacgtgtggggagcacttccccgtggagcctgggtgctgtggggctgtggcatcctccctgtgctggcggtcactgctctcactggcccagcatgcaggccttcttacaggccaccgccgagaccagggccgcgccccggccactgccctcctccgactcgatgaaggtgatctcgcagctgggcgtcagcctgcgcacgctagcgtggaaccgctccttgaagctggggtgcagcttgtacacggagccatccacgcccacagtgatgcgcattacgtcctcgctgcggctctcgcgcatgcggttgatgacgcccgccagccccgccgagcacatgtgtgcagcgcgcgtagacacgctctcgcaggcgcggcgcacgatgtcgcagtcagtggccgagggtcgtagccccagcgtgctcaggatgttgtagatctgcttgcggtcgcccgtgtcgagctgctgaccggggtttgcagagctctcgtccaccaggcggtcatactccagcaggaactcgtccagctcgcccgagtccccgaaggcgccccattcggtgttgacgcacatgcggccctcgtccccctccaccagctccacattctgcatctcctccatgtagcaggcgttgcagcccgtgcccacaatcatgccgacctcgcactgatggtcttcgtagtagcaggagatcatcgtggccaccgtgtcattcaccattgccaccacatccatttcgaagtcccctctccgtttgatggcatctcgcagaagccccacgacattgttcccttctgctcctgaggccttgaagcccttggtccagttgagaaggatgcccttatcgatgtcttcatgcctcacaggaaaggagaaggtgaagcccaggggcagcttcttgtgcttcatctgatgcttgtccaggaagtcggagatgcactcggagatgtagtcgaagagcatctcagcagtgccggtcatggcgtcctcggggatggagtacatctggtgtttggtcttcacgctccactgcccctcctcaccttctcccaccttcaccagcatcaccctgaagttggtgccacccaggtccagggagaggaagtccccgacttctgagccttctggggtggagcgcacgtaggtgggcagcatcttcacactggcctcttcatgggtctccaacctcaggccacggtccatctccttctgcatccgtctcatcaccttcttcaggtcctcctcctgcagctggaactccgccaggatctgctctaccagagtcaaggctgtctgggcctggctccttgtggcatccatcgccatctctccgagggactaagaggtagatgctttgggaagcagagatgctcctgcctgccgaggcctagcacatgctgtagccttggagcataaggcccccgctgtggcagcaatggctgcctggatggagagctgcctgaggctggcagcccagggcttctgcactgaaagg

SEQ ID NO: 20 - DNA, 2727 bp, Mus musculus
aagtagttttaaatatttaattaaaaactcccccatggttccaagctggtgtggagagggcggcatggcatctgggaaacctgacagggatgagggacagagggacctgggtggtttcctggagagatgctgtgggtggcttgcttctcttcccggatcactgatgtgagtgttgaagctgccatcctgctaacagtgcagagtgaggcgctccccttcaggtcccctagagcaaggactctgggcctctatcctctggcatctcctaggagggttcatcccagaactgtaagccactcaggggtggaggtatatgaaggagactgtctctggaatgtttgtggcctggaaagtcccctccatgtagctagatagtcggtctcccatggttttgcagcctcttcagccacaggcaagaaaacagccaggtctgggcagcccttactcttctgggggcccaggtctggtctggccaagctgctgaagctacctccccatggagatgtgttcccagggaagccaggccattgcaagtccaggaggcactcccttgggaggccagacccacagctgtgggaggccagaagctgaaagagcaagacctgagtgtgcttcacctttctctgtagttgattctagcaagaaaggcttttggtgccgctgatcctcttgccccttgccccaggctgagagccctagggctgtctcactggctgacttggcttgcaggggcctctccccattttccaggggtagcagcagaataggtctcctgccctagtggactgggagcatttgtggggtgtggagtccccgtggaacccaggtccctgtccttgcctggatttcactggcccagcatgcaagccttcttgcaggccaccgcagagaccagtgcggctcccctgccgctgccctcctctgattcaatgaaggtgatttcgcagttgggtgtcagcctgcgcacactggcgtgaaaccgctccttgaagctcgggtgcagcttgtacacggagccatccacgcccaccgtgatgcgcatcacgtcctcactgcggctttcgcgcatgcgatttatgacccccgctagtcctgctgagcacatgtgggcggcgcgagtggacacgctttcacaggcacggcgcacaatgtcgcagtcggcgacagagggtcgaaggcccagagtgctcaggatgttaaggatctgccttcggtccccagagtcgctctccacctgcgacacaaaacgggtctcaaaagcaccacgtgtgcgcagctgctctgaggcctctccgtggaacagaagattctcctctaccagcttgagcagcacaagtcgtaccagctcgcccatgtactttccgccaatgatcttttcgtacagctgctgaccggggttcactgagctctcatccaccatccggtcgtactccaggaggaactcgtccagctcaccggagttcccgaaggcgccccactctgtgttgacacacatgcgcccctcatcgccttccaccagctccacattctgcatctcctccatgtagcaggcgttgcagccggtgcccacaatcatgccgacctcacattggcggtcttcatagtagcaggagatcattgtggccaccgtgtcattcaccattgccaccacatccatctcaaagtcccctctcctcttgatagcatctcggagaagtcccacgatgttgttcccttctgctccggaggccttgaagcccttggtccagttgagcaggatgcccttgtctatgtcttcgtgccttacagggaaggagaaggtgaagcccaggggtagtttcttgtgtttcatctgatgcttgtccaggaagtcagagatgcactcagagatgtagtcaaagagcatctccgcagtgcccgtcatggcgtcctcggggatggaatacatctggtgtttcgtcttcacgctccactgtcctgcctccccctcccccactttcaccagcatcaccctgaagttggttcctcccaggtctaaggagagaaagtctccaacttctgagccttctggggtggaacgcacgtaggtgggcaacatctttacactggcctcctgatgggtctccagcttcaggccacggtccatctccttctgcatccggctcatcaccttcttcaggtcttcctcctgcagctggaactctgccaggatctgctctaccttttccttcttggtggcctccatcctggctctgtcatccagcatctgcccagccgccagcccaggtgagctgggacccctcagtgttccgcagcagctttccaaagcagaagtagcccagacttcccccacagagtcacagccagccccggacctcagagagctctgccgtccacctcaggctggttgaagccacagcttcctctttttcattgttcacttctggacccctccccaccaaggcctcttcaggcccagcggtcttcaggaggagccatgtggttcctcagtgttgactgactttcttccagctctgctgagctgtgaggaactggtggcctctagacggactcagcacaaaaggtctctccctccagtggcttggggatggcttttgagtaatgaggcaacaggtaactctctgtccctcacgcctcagctttcttctctgggctcagtcacagtcggtgcttctgttccaaccaggtgtggagtagatgtctcctgtcagggcctctgtgctcctg

SEQ ID NO: 21 - DNA, 2372 bp, Mus musculus
tttaagtagttttaaatatttaattaaaaactcccccatggttccaagctggtgtggagagggcggcatggcatctgggaaacctgacagggatgagggacagagggacctgggtggtttcctggagagatgctgtgggtggcttgcttctcttcccggatcactgatgtgagtgttgaagctgccatcctgctaacagtgcagagtgaggcgctccccttcaggtcccctagagcaaggactctgggcctctatcctctggcatctcctaggagggttcatcccagaactgtaagccactcaggggtggaggtatatgaaggagactgtctctggaatgtttgtggcctggaaagtcccctccatgtagctagatagtcggtctcccatggttttgcagcctcttcagccacaggcaagaaaacagccaggtctgggcagcccttactcttctgggggcccaggtctggtctggccaagctgctgaagctacctccccatggagatgtgttcccagggaagccaggccattgcaagtccaggaggcactcccttgggaggccagacccacagctgtgggaggccagaagctgaaagagcaagacctgagtgtgcttcacctttctctgtagttgattctagcaagaaaggcttttggtgccgctgatcctcttgccccttgccccaggctgagagccctagggctgtctcactggctgacttggcttgcaggggcctctccccattttccaggggtagcagcagaataggtctcctgccctagtggactgggagcatttgtggggtgtggagtccccgtggaacccaggtccctgtccttgcctggatttcactggcccagcatgcaagccttcttgcaggccaccgcagagaccagtgcggctcccctgccgctgccctcctctgattcaatgaaggtgatttcgcagttgggtgtcagcctgcgcacactggcgtgaaaccgctccttgaagctcgggtgcagcttgtacacggagccatccacgcccaccgtgatgcgcatcacgtcctcactgcggctttcgcgcatgcgatttatgacccccgctagtcctgctgagcacatgtgggcggcgcgagtggacacgctttcacaggcacggcgcacaatgtcgcagtcggcgacagagggtcgaaggcccagagtgctcaggatgttaaggatctgccttcggtccccagagtcgctctccacctgcgacacaaaacgggtctcaaaagcaccacgtgtgcgcagctgctctgaggcctctccgtggaacagaagattctcctctaccagcttgagcagcacaagtcgtaccagctcgcccatgtactttccgccaatgatcttttcgtacagctgctgaccggggttcactgagctctcatccaccatccggtcgtactccaggaggaactcgtccagctcaccggagttcccgaaggcgccccactctgtgttgacacacatgcgcccctcatcgccttccaccagctccacattctgcatctcctccatgtagcaggcgttgcagccggtgcccacaatcatgccgacctcacattggcggtcttcatagtagcaggagatcattgtggccaccgtgtcattcaccattgccaccacatccatctcaaagtcccctctcctcttgatagcatctcggagaagtcccacgatgttgttcccttctgctccggaggccttgaagcccttggtccagttgagcaggatgcccttgtctatgtcttcgtgccttacagggaaggagaaggtgaagcccaggggtagtttcttgtgtttcatctgatgcttgtccaggaagtcagagatgcactcagagatgtagtcaaagagcatctccgcagtgcccgtcatggcgtcctcggggatggaatacatctggtgtttcgtcttcacgctccactgtcctgcctccccctcccccactttcaccagcatcaccctgaagttggttcctcccaggtctaaggagagaaagtctccaacttctgagccttctggggtggaacgcacgtaggtgggcaacatctttacactggcctcctgatgggtctccagcttcaggccacggtccatctccttctgcatccggctcatcaccttcttcaggtcttcctcctgcagctggaactctgccaggatctgctctaccagagtcaacgactgggctcccctccttgtagtatccacagccatctgaggataagcaggggtcgttggggaagtagagatgttcctgactcccgaggccacctgctgtgggtgaggactgtctggctgagtgttgcaaaagacaggcagccaaggacttctgcactaa

SEQ ID NO: 22 - DNA, 2343 bp, Rattus norvegicus
tgaagtagttttaaatatttaattaaaaactcccccacagtcccaggtagagaggctggcatttgggaacgagggagagaaggacctgggtggtctcttggagggacactgagggtggcttcttcctcctgggtcagggacctgagtgttggagatgattcctgcttgaatagtgcagagtgaggcctcccctttctggtccccttagagcaaggactctggggctctaacctctggcatctcctgggagggttcatcccagaactgtaagccactcgggtggaggtatatgaaggcaacagtctctggcatgttcatgcctggaaagtcctctccatgtagccggatagtcagtctctcatggctccccggcctcttcagccacagacaagaaaacagccaggtctgggtgactagcagcccttactctcctggggtctggtctggccgaactgctgaagttacctccccatgaaggtgtgtcccccccagggaagccaggccattgcaaggtccaggaagcattcccttgggaggccagacccacgcttgggaagcaagaatcgtgaaagtgcaagtcctgagtattttccgccattttctgtagttgattctagcaagaaaggccttggcgcctctgatcctcttcttcctcccagccccctgccccaggctgagagccctagggctgtcccactggccgactcggcttgcaggggcctctccccattttccaggggtagcagcagaataggtctcctgccccggtgggctgggagcatttgtggtgtgtggagtccccgtggaacccaggtcccggtccatatgacctggatttcactgggccagcatgcaagccttcttgcaggccaccgcagagaccagcgcggctcccctgccgctgccctcctctgattcgatgaaggtgatttcgcagttgggtgtcagcctgcgcacactggcgtgaaaccgctccttgaagctcgggtgcagcttgtacacggagccatccacgcccacagtgatgcgcatcacgtcctcactgcggctttcgcgcatgcgatttatgaccccagctagtcctgcggagcacatatgggcggcgcgagtggacacgctttcacaggcacggcgcacaatgtcgcagtcggtgacagagggtcgaagccccagagtgcttaggatgttgtggatctgctttcggtccccggagtcgctctccacttgtgacacgaaacgggtctcaaaagcaccacgcgtgcgcagctgctccgaggcctctccgtggaacagaaggttctcgtccaccagcttaagcagcacaagtcgtaccagctcgcccatatacttcccaccgatgatcttctcgtacagctgctgaccggggttcgctgagctttcatccaccatccggtcatactccagtaggaactcatccagctcgcccgagtccccgaaggcgccccactccgtgttgacgcacatgcgtccctcatccccttccaccagctccacattctgcatttcctccatgtagcaggcattgcagccagtgcccacaatcatgccgacctcacattggcggtcttcatagtagcaggagatcattgtggccactgtgtcgttcaccattgccaccacatccatctcaaagtcccctctcctcttgatagcatctcggagaagtcctacgatgttgttcccttctgctccagaggccttgaagcccttggtccaattgaggaggatgcccttgtctaggtcttcgtgcctcacagggaaggagaaggtgaagcccaggggcagtttcttgtgcttcatctgatgcttgtcaaggaagtcagagatgcattcagagatgtagtcaaagagcatctcggcagtgcccgtcatggcgtcctcggggatggagtacatctggtgttttgtcttcacgctccactgccctgcctccccctctcccactttgaccagcatcactctgaagttggttcctcccaggtctaaggagagaaagtctccgacttctgagccttctggggtggaacgcacgtaggtgggtaacatctttacactggcctcctcgtgggtctccagcctcaggccacggtccatctccttctgcatccggctcatcaccttcttcaggtcttcctcctgcagctggaactctgccaggatctgctcgaccagagtcaacaactgggctccacaccttgtagtatccatagccatctctgagaggacaacccaggggtcgttggggaagtagagatgttcctgactcctgaggccacctgttgcaggtgaggactgtctggctgagtgttgcaaaagataggc

SEQ ID NO: 23 - DNA, 2442 bp, Rattus norvegicus
tgaagtagttttaaatatttaattaaaaactcccccacagtcccaggtagagaggctggcatttgggaacgagggagagaaggacctgggtggtctcttggagggacactgagggtggcttcttcctcctgggtcagggacctgagtgttggagatgattcctgcttgaatagtgcagagtgaggcctcccctttctggtccccttagagcaaggactctggggctctaacctctggcatctcctgggagggttcatcccagaactgtaagccactcgggtggaggtatatgaaggcaacagtctctggcatgttcatgcctggaaagtcctctccatgtagccggatagtcagtctctcatggctccccggcctcttcagccacagacaagaaaacagccaggtctgggtgactagcagcccttactctcctggggtctggtctggccgaactgctgaagttacctccccatgaaggtgtgtcccccccagggaagccaggccattgcaaggtccaggaagcattcccttgggaggccagacccacgcttgggaagcaagaatcgtgaaagtgcaagtcctgagtattttccgccattttctgtagttgattctagcaagaaaggccttggcgcctctgatcctcttcttcctcccagccccctgccccaggctgagagccctagggctgtcccactggccgactcggcttgcaggggcctctccccattttccaggggtagcagcagaataggtctcctgccccggtgggctgggagcatttgtggtgtgtggagtccccgtggaacccaggtcccggtccatatgacctggatttcactgggccagcatgcaagccttcttgcaggccaccgcagagaccagcgcggctcccctgccgctgccctcctctgattcgatgaaggtgatttcgcagttgggtgtcagcctgcgcacactggcgtgaaaccgctccttgaagctcgggtgcagcttgtacacggagccatccacgcccacagtgatgcgcatcacgtcctcactgcggctttcgcgcatgcgatttatgaccccagctagtcctgcggagcacatatgggcggcgcgagtggacacgctttcacaggcacggcgcacaatgtcgcagtcggtgacagagggtcgaagccccagagtgcttaggatgttgtggatctgctttcggtccccggagtcgctctccacttgtgacacgaaacgggtctcaaaagcaccacgcgtgcgcagctgctccgaggcctctccgtggaacagaaggttctcgtccaccagcttaagcagcacaagtcgtaccagctcgcccatatacttcccaccgatgatcttctcgtacagctgctgaccggggttcgctgagctttcatccaccatccggtcatactccagtaggaactcatccagctcgcccgagtccccgaaggcgccccactccgtgttgacgcacatgcgtccctcatccccttccaccagctccacattctgcatttcctccatgtagcaggcattgcagccagtgcccacaatcatgccgacctcacattggcggtcttcatagtagcaggagatcattgtggccactgtgtcgttcaccattgccaccacatccatctcaaagtcccctctcctcttgatagcatctcggagaagtcctacgatgttgttcccttctgctccagaggccttgaagcccttggtccaattgaggaggatgcccttgtctaggtcttcgtgcctcacagggaaggagaaggtgaagcccaggggcagtttcttgtgcttcatctgatgcttgtcaaggaagtcagagatgcattcagagatgtagtcaaagagcatctcggcagtgcccgtcatggcgtcctcggggatggagtacatctggtgttttgtcttcacgctccactgccctgcctccccctctcccactttgaccagcatcactctgaagttggttcctcccaggtctaaggagagaaagtctccgacttctcctcgtgggtctccagcctcaggccacggtccatctccttctgcatccggctcatcaccttcttcaggtcttcctcctgcagctggaactctgccaggatctgctcgaccctccacatgatagttcaagagtagctggactctgcaggtgggcagctgtgtggcggccgcctgctctgttcggcagcgagggttcatgtgcccgttgtgagtacccgctctgcacagcagggagcatgcattcgtgcatttgttggtgcccagagtcaacaactgggctccacaccttgtagtatccatagccatctctgagaggacaacccaggggtcgttggggaagtagagatgttcctgactcctgaggccacctgttgcaggtgaggactgtctggctgagtgttgcaaaagataggc

SEQ ID NO: 24 - DNA, 2220 bp, Rattus norvegicus
tgaagtagttttaaatatttaattaaaaactcccccacagtcccaggtagagaggctggcatttgggaacgagggagagaaggacctgggtggtctcttggagggacactgagggtggcttcttcctcctgggtcagggacctgagtgttggagatgattcctgcttgaatagtgcagagtgaggcctcccctttctggtccccttagagcaaggactctggggctctaacctctggcatctcctgggagggttcatcccagaactgtaagccactcgggtggaggtatatgaaggcaacagtctctggcatgttcatgcctggaaagtcctctccatgtagccggatagtcagtctctcatggctccccggcctcttcagccacagacaagaaaacagccaggtctgggtgactagcagcccttactctcctggggtctggtctggccgaactgctgaagttacctccccatgaaggtgtgtcccccccagggaagccaggccattgcaaggtccaggaagcattcccttgggaggccagacccacgcttgggaagcaagaatcgtgaaagtgcaagtcctgagtattttccgccattttctgtagttgattctagcaagaaaggccttggcgcctctgatcctcttcttcctcccagccccctgccccaggctgagagccctagggctgtcccactggccgactcggcttgcaggggcctctccccattttccaggggtagcagcagaataggtctcctgccccggtgggctgggagcatttgtggtgtgtggagtccccgtggaacccaggtcccggtccatatgacctggatttcactgggccagcatgcaagccttcttgcaggccaccgcagagaccagcgcggctcccctgccgctgccctcctctgattcgatgaaggtgatttcgcagttgggtgtcagcctgcgcacactggcgtgaaaccgctccttgaagctcgggtgcagcttgtacacggagccatccacgcccacagtgatgcgcatcacgtcctcactgcggctttcgcgcatgcgatttatgaccccagctagtcctgcggagcacatatgggcggcgcgagtggacacgctttcacaggcacggcgcacaatgtcgcagtcggtgacagagggtcgaagccccagagtgcttaggatgttgtggatctgctttcggtccccggagtcgctctccacttgtgacacgaaacgggtctcaaaagcaccacgcgtgcgcagctgctccgaggcctctccgtggaacagaaggttctcgtccaccagcttaagcagcacaagtcgtaccagctcgcccatatacttcccaccgatgatcttctcgtacagctgctgaccggggttcgctgagctttcatccaccatccggtcatactccagtaggaactcatccagctcgcccgagtccccgaaggcgccccactccgtgttgacgcacatgcgtccctcatccccttccaccagctccacattctgcatttcctccatgtagcaggcattgcagccagtgcccacaatcatgccgacctcacattggcggtcttcatagtagcaggagatcattgtggccactgtgtcgttcaccattgccaccacatccatctcaaagtcccctctcctcttgatagcatctcggagaagtcctacgatgttgttcccttctgctccagaggccttgaagcccttggtccaattgaggaggatgcccttgtctaggtcttcgtgcctcacagggaaggagaaggtgaagcccaggggcagtttcttgtgcttcatcatctcggcagtgcccgtcatggcgtcctcggggatggagtacatctggtgttttgtcttcacgctccactgccctgcctccccctctcccactttgaccagcatcactctgaagttggttcctcccaggtctaaggagagaaagtctccgacttctgagccttctggggtggaacgcacgtaggtgggtaacatctttacactggcctcctcgtgggtctccagcctcaggccacggtccatctccttctgcatccggctcatcaccttcttcaggtcttcctcctgcagctggaactctgccaggatctgctcgaccttttccttcttggtggcctccatcctggctctgtcatccagcatctgcgcagccaccagcccaggtgaactgggaccccc

SEQ ID NO: 25 - protein, 16 aa, Unknown
  source: /note="Description of Unknown: RFGF peptide"
AAVALLPAVLLALLAP

SEQ ID NO: 26 - protein, 11 aa, Unknown
  source: /note="Description of Unknown: RFGF analogue peptide"
AALLPVLLAAP

SEQ ID NO: 27 - protein, 13 aa, Human immunodeficiency virus
GRKKRRQRRRPPQ

SEQ ID NO: 28 - protein, 16 aa, Drosophila sp.
RQIKIWFQNRRMKWKK

SEQ ID NO: 29 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacgcugaguacuucgatt

SEQ ID NO: 30 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaguacucagcguaagtt

SEQ ID NO: 31 - RNA, 21 nt, Artificial Sequence
  source: /note="Description of Artificial Sequence: Synthetic oligonucleotide"
gaggaccugaagaaggugaua

SEQ ID NO: 32 - RNA, 21 nt, Artificial Sequence
  source: /note="Description of Artificial Sequence: Synthetic oligonucleotide"
ggaccugaagaaggugaugaa

SEQ ID NO: 33 - RNA, 19 nt, Artificial Sequence
  source: /note="Description of Artificial Sequence: Synthetic oligonucleotide"
ggaccugaagaaggugaua

SEQ ID NO: 34 - RNA, 19 nt, Artificial Sequence
  source: /note="Description of Artificial Sequence: Synthetic oligonucleotide"
accugaagaaggugaugaa

SEQ ID NO: 35 - RNA, 21 nt, Artificial Sequence
  source: /note="Description of Artificial Sequence: Synthetic oligonucleotide"
ggugaugagacggaugcagaa

SEQ ID NO: 36 - RNA, 21 nt, Artificial Sequence
  source: /note="Description of Artificial Sequence: Synthetic oligonucleotide"
ugaugagacggaugcagaaga

SEQ ID NO: 37 - RNA, 19 nt, Artificial Sequence
  source: /note="Description of Artificial Sequence: Synthetic oligonucleotide"
ugaugagacggaugcagaa

SEQ ID NO: 38 - RNA, 19 nt, Artificial Sequence
  source: /note="Description of Artificial Sequence: Synthetic oligonucleotide"
augagacggaugcagaaga

SEQ ID NO: 39 - RNA, 21 nt, Artificial Sequence
  source: /note="Description of Artificial Sequence: Synthetic oligonucleotide"
acggaugcagaaggagaugga

SEQ ID NO: 40 - RNA, 19 nt, Artificial Sequence
  source: /note="Description of Artificial Sequence: Synthetic oligonucleotide"
ggaugcagaaggagaugga

SEQ ID NO: 41 - RNA, 21 nt, Artificial Sequence
  source: /note="Description of Artificial Sequence: Synthetic oligonucleotide"
acccaugaagaggccagugua

SEQ ID NO: 42 - RNA, 19 nt, Artificial Sequence
  source: /note="Description of Artificial Sequence: Synthetic oligonucleotide"
ccaugaagaggccagugua

SEQ ID NO: 43 - RNA, 21 nt, Artificial Sequence
  source: /note="Description of Artificial Sequence: Synthetic oligonucleotide"
cagugugaagaugcugcccaa

SEQ ID NO: 44 - RNA, 19 nt, Artificial Sequence
  source: /note="Description of Artificial Sequence: Synthetic oligonucleotide"
gugugaagaugcugcccaa

SEQ ID NO: 45 - RNA, 21 nt, Artificial Sequence
  source: /note="Description of Artificial Sequence: Synthetic oligonucleotide"
gugaaggugggagaaggugaa

SEQ ID NO: 46 - RNA, 19 nt, Artificial Sequence
  source: /note="Description of Artificial Sequence: Synthetic oligonucleotide"
gaaggugggagaaggugaa

SEQ ID NO: 47 - RNA, 21 nt, Artificial Sequence
  source: /note="Description of Artificial Sequence: Synthetic oligonucleotide"
gagcgugaagaccaaacacca

SEQ ID NO: 48 - RNA, 19 nt, Artificial Sequence
  source: /note="Description of Artificial Sequence: Synthetic oligonucleotide"
gcgugaagaccaaacacca

SEQ ID NO: 49 - RNA, 21 nt, Artificial Sequence
  source: /note="Description of Artificial Sequence: Synthetic oligonucleotide"
gaagaccaaacaccagaugua

SEQ ID NO: 50 - RNA, 19 nt, Artificial Sequence
  source: /note="Description of Artificial Sequence: Synthetic oligonucleotide"
agaccaaacaccagaugua

SEQ ID NO: 51 - RNA, 21 nt, Artificial Sequence
  source: /note="Description of Artificial Sequence: Synthetic oligonucleotide"
gacuuccuggacaagcaucaa

SEQ ID NO: 52 - RNA, 21 nt, Artificial Sequence
  source: /note="Description of Artificial Sequence: Synthetic oligonucleotide"
cuuccuggacaagcaucagau

SEQ ID NO: 53 - RNA, 19 nt, Artificial Sequence
  source: /note="Description of Artificial Sequence: Synthetic oligonucleotide"
cuuccuggacaagcaucaa

SEQ ID NO: 54 - RNA, 19 nt, Artificial Sequence
  source: /note="Description of Artificial Sequence: Synthetic oligonucleotide"
uccuggacaagcaucagau

SEQ ID NO: 55 - RNA, 21 nt, Artificial Sequence
  source: /note="Description of Artificial Sequence: Synthetic oligonucleotide"
ccuggacaagcaucagaugaa

SEQ ID NO: 56 - RNA, 21 nt, Artificial Sequence
  source: /note="Description of Artificial Sequence: Synthetic oligonucleotide"
cuggacaagcaucagaugaaa

SEQ ID NO: 57 - RNA, 19 nt, Artificial Sequence
  source: /note="Description of Artificial Sequence: Synthetic oligonucleotide"
uggacaagcaucagaugaa

SEQ ID NO: 58 - RNA, 19 nt, Artificial Sequence
  source: /note="Description of Artificial Sequence: Synthetic oligonucleotide"
ggacaagcaucagaugaaa

SEQ ID NO: 59 - RNA, 21 nt, Artificial Sequence
  source: /note="Description of Artificial Sequence: Synthetic oligonucleotide"
aggcacgaagacaucgauaaa

SEQ ID NO: 60 - RNA, 19 nt, Artificial Sequence
  source: /note="Description of Artificial Sequence: Synthetic oligonucleotide"
gcacgaagacaucgauaaa

SEQ ID NO: 61 - RNA, 21 nt, Artificial Sequence
  source: /note="Description of Artificial Sequence: Synthetic oligonucleotide"
acaucgauaagggcauccuua

SEQ ID NO: 62 - RNA, 19 nt, Artificial Sequence
  source: /note="Description of Artificial Sequence: Synthetic oligonucleotide"
aucgauaagggcauccuua

SEQ ID NO: 63 - RNA, 21 nt, Artificial Sequence
  source: /note="Description of Artificial Sequence: Synthetic oligonucleotide"
cuggaccaagggcuucaagga

SEQ ID NO: 64 - RNA, 19 nt, Artificial Sequence
  source: /note="Description of Artificial Sequence: Synthetic oligonucleotide"
ggaccaagggcuucaagga

SEQ ID NO: 65 - RNA, 21 nt, Artificial Sequence
  source: /note="Description of Artificial Sequence: Synthetic oligonucleotide"
gggcuucaaggccucaggaga

SEQ ID NO: 66 - RNA, 19 nt, Artificial Sequence
  source: /note="Description of Artificial Sequence: Synthetic oligonucleotide"
gcuucaaggccucaggaga

SEQ ID NO: 67 - RNA, 21 nt, Artificial Sequence
  source: /note="Description of Artificial Sequence: Synthetic oligonucleotide"
caggagcagaagggaacaaua

SEQ ID NO: 68 - RNA, 21 nt, Artificial Sequence
  source: /note="Description of Artificial Sequence: Synthetic oligonucleotide"
ggagcagaagggaacaaugua

SEQ ID NO: 69 - RNA, 19 nt, Artificial Sequence
  source: /note="Description of Artificial Sequence: Synthetic oligonucleotide"
ggagcagaagggaacaaua

SEQ ID NO: 70 - RNA, 21 nt, Artificial Sequence
  source: /note="Description of Artificial Sequence: Synthetic oligonucleotide"
gagcagaagggaacaauguca

SEQ ID NO: 71 - RNA, 19 nt, Artificial Sequence
  source: /note="Description of Artificial Sequence: Synthetic oligonucleotide"
agcagaagggaacaaugua

SEQ ID NO: 72 - RNA, 19 nt, Artificial Sequence
  source: /note="Description of Artificial Sequence: Synthetic oligonucleotide"
gcagaagggaacaauguca

SEQ ID NO: 73 - RNA, 21 nt, Artificial Sequence
  source: /note="Description of Artificial Sequence: Synthetic oligonucleotide"
gacuuugaaauggauguggua

SEQ ID NO: 74 - RNA, 21 nt, Artificial Sequence
  source: /note="Description of Artificial Sequence: Synthetic oligonucleotide"
cuuugaaauggauguggugga

SEQ ID NO: 75 - RNA, 19 nt, Artificial Sequence
  source: /note="Description of Artificial Sequence: Synthetic oligonucleotide"
cuuugaaauggauguggua

SEQ ID NO: 76 - RNA, 19 nt, Artificial Sequence
  source: /note="Description of Artificial Sequence: Synthetic oligonucleotide"
uugaaauggauguggugga

SEQ ID NO: 77 - RNA, 21 nt, Artificial Sequence
  source: /note="Description of Artificial Sequence: Synthetic oligonucleotide"
ugaaauggaugugguggcaau

SEQ ID NO: 78 - RNA, 19 nt, Artificial Sequence
  source: /note="Description of Artificial Sequence: Synthetic oligonucleotide"
aaauggaugugguggcaau

SEQ ID NO: 79 - RNA, 21 nt, Artificial Sequence
  source: /note="Description of Artificial Sequence: Synthetic oligonucleotide"
auggaugugguggcaauggua

SEQ ID NO: 80 - RNA, 21 nt, Artificial Sequence
  source: /note="Description of Artificial Sequence: Synthetic oligonucleotide"
auggaugugguggcaauggua

SEQ ID NO: 81 - RNA, 21 nt, Artificial Sequence
  source: /note="Description of Artificial Sequence: Synthetic oligonucleotide"
ggaugugguggcaauggugaa

SEQ ID NO: 82 - RNA, 19 nt, Artificial Sequence
  source: /note="Description of Artificial Sequence: Synthetic oligonucleotide"
ggaugugguggcaauggua

SEQ ID NO: 83 - RNA, 19 nt, Artificial Sequence
  source: /note="Description of Artificial Sequence: Synthetic oligonucleotide"
augugguggcaauggugaa

SEQ ID NO: 84 - RNA, 21 nt, Artificial Sequence
  source: /note="Description of Artificial Sequence: Synthetic oligonucleotide"
gcaauggugaaugacacggua

SEQ ID NO: 85 - RNA, 19 nt, Artificial Sequence
  source: /note="Description of Artificial Sequence: Synthetic oligonucleotide"
aauggugaaugacacggua

SEQ ID NO: 86 - RNA, 21 nt, Artificial Sequence
  source: /note="Description of Artificial Sequence: Synthetic oligonucleotide"
cagugcgaggucggcaugaua

SEQ ID NO: 87 - RNA, 19 nt, Artificial Sequence
  source: /note="Description of Artificial Sequence: Synthetic oligonucleotide"
gugcgaggucggcaugaua

SEQ ID NO: 88 - RNA, 21 nt, Artificial Sequence
  source: /note="Description of Artificial Sequence: Synthetic oligonucleotide"
acauggaggagaugcagaaua

SEQ ID NO: 89 - RNA, 19 nt, Artificial Sequence
  source: /note="Description of Artificial Sequence: Synthetic oligonucleotide"
auggaggagaugcagaaua

SEQ ID NO: 90 - RNA, 21 nt, Artificial Sequence
  source: /note="Description of Artificial Sequence: Synthetic oligonucleotide"
gaugcagaauguggagcuggu

SEQ ID NO: 91 - RNA, 19 nt, Artificial Sequence
  source: /note="Description of Artificial Sequence: Synthetic oligonucleotide"
ugcagaauguggagcuggu

SEQ ID NO: 92 - RNA, 21 nt, Artificial Sequence
  source: /note="Description of Artificial Sequence: Synthetic oligonucleotide"
guggacgagagcucugcaaaa

SEQ ID NO: 93 - RNA, 19 nt, Artificial Sequence
  source: /note="Description of Artificial Sequence: Synthetic oligonucleotide"
ggacgagagcucugcaaaa

SEQ ID NO: 94 - RNA, 21 nt, Artificial Sequence
  source: /note="Description of Artificial Sequence: Synthetic oligonucleotide"
aaguacaugggcgagcuggua

SEQ ID NO: 95 - RNA, 19 nt, Artificial Sequence
  source: /note="Description of Artificial Sequence: Synthetic oligonucleotide"
guacaugggcgagcuggua

SEQ ID NO: 96 - RNA, 21 nt, Artificial Sequence
  source: /note="Description of Artificial Sequence: Synthetic oligonucleotide"
aggcucguggacgaaaaccua

SEQ ID NO: 97 - RNA, 19 nt, Artificial Sequence
  source: /note="Description of Artificial Sequence: Synthetic oligonucleotide"
gcucguggacgaaaaccua

SEQ ID NO: 98 - RNA, 21 nt, Artificial Sequence
  source: /note="Description of Artificial Sequence: Synthetic oligonucleotide"
cguggacgaaaaccugcucuu

SEQ ID NO: 99 - RNA, 21 nt, Artificial Sequence
  source: /note="Description of Artificial Sequence: Synthetic oligonucleotide"
guggacgaaaaccugcucuua

SEQ ID NO: 100 - RNA, 19 nt, Artificial Sequence
  source: /note="Description of Artificial Sequence: Synthetic oligonucleotide"
uggacgaaaaccugcucuu

SEQ ID NO: 101 - RNA, 19 nt, Artificial Sequence
  source: /note="Description of Artificial Sequence: Synthetic oligonucleotide"
ggacgaaaaccugcucuua

SEQ ID NO: 102 - RNA, 21 nt, Artificial Sequence
  source: /note="Description of Artificial Sequence: Synthetic oligonucleotide"
cgcaagcagaucuacaacaua

SEQ ID NO: 103 - RNA, 19 nt, Artificial Sequence
  source: /note="Description of Artificial Sequence: Synthetic oligonucleotide"
caagcagaucuacaacaua

SEQ ID NO: 104 - RNA, 21 nt, Artificial Sequence
  source: /note="Description of Artificial Sequence: Synthetic oligonucleotide"
agcugcgagaucaccuucaua

SEQ ID NO: 105 - RNA, 19 nt, Artificial Sequence
  source: /note="Description of Artificial Sequence: Synthetic oligonucleotide"
cugcgagaucaccuucaua

SEQ ID NO: 106 - RNA, 21 nt, Artificial Sequence
  source: /note="Description of Artificial Sequence: Synthetic oligonucleotide"
ccaguccuggccauuuucuua

SEQ ID NO: 107 - RNA, 19 nt, Artificial Sequence
  source: /note="Description of Artificial Sequence: Synthetic oligonucleotide"
aguccuggccauuuucuua

SEQ ID NO: 108 - RNA, 21 nt, Artificial Sequence
  source: /note="Description of Artificial Sequence: Synthetic oligonucleotide"
cacugaguggcuugugauucu

SEQ ID NO: 109 - RNA, 19 nt, Artificial Sequence
  source: /note="Description of Artificial Sequence: Synthetic oligonucleotide"
cugaguggcuugugauucu

SEQ ID NO: 110 - RNA, 21 nt, Artificial Sequence
  source: /note="Description of Artificial Sequence: Synthetic oligonucleotide"
aauguuaaaaguuuuaaacau

SEQ ID NO: 111 - RNA, 19 nt, Artificial Sequence
  source: /note="Description of Artificial Sequence: Synthetic oligonucleotide"
uguuaaaaguuuuaaacau

SEQ ID NO: 112 - RNA, 19 nt, Artificial Sequence
  source: /note="Description of Artificial Sequence: Synthetic oligonucleotide"
agcagaagggaacaacaua

SEQ ID NO: 113 - RNA, 21 nt, Artificial Sequence
  source: /note="Description of Artificial Sequence: Synthetic oligonucleotide"
ggagcagaagggaacaacaua

SEQ ID NO: 114 - RNA, 19 nt, Artificial Sequence
  source: /note="Description of Artificial Sequence: Synthetic oligonucleotide"
ucuccgagaugcuaucaaa

SEQ ID NO: 115 - RNA, 21 nt, Artificial Sequence
  source: /note="Description of Artificial Sequence: Synthetic oligonucleotide"
cuucuccgagaugcuaucaaa

SEQ ID NO: 116 - RNA, 19 nt, Artificial Sequence
  source: /note="Description of Artificial Sequence: Synthetic oligonucleotide"
agauggaugugguggcaau

SEQ ID NO: 117 - RNA, 21 nt, Artificial Sequence
  source: /note="Description of Artificial Sequence: Synthetic oligonucleotide"
ugagauggaugugguggcaau

SEQ ID NO: 118 - RNA, 19 nt, Artificial Sequence
  source: /note="Description of Artificial Sequence: Synthetic oligonucleotide"
cugcgaaaucaccuucauu

SEQ ID NO: 119 - RNA, 21 nt, Artificial Sequence
  source: /note="Description of Artificial Sequence: Synthetic oligonucleotide"
aacugcgaaaucaccuucauu

SEQ ID NO: 120 - RNA, 23 nt, Artificial Sequence
  source: /note="Description of Artificial Sequence: Synthetic oligonucleotide"
uaucaccuucuucagguccuccu

SEQ ID NO: 121 - RNA, 23 nt, Artificial Sequence
  source: /note="Description of Artificial Sequence: Synthetic oligonucleotide"
uucaucaccuucuucagguccuc

SEQ ID NO: 122 - RNA, 19 nt, Artificial Sequence
  source: /note="Description of Artificial Sequence: Synthetic oligonucleotide"
uaucaccuucuucaggucc

SEQ ID NO: 123 - RNA, 19 nt, Artificial Sequence
  source: /note="Description of Artificial Sequence: Synthetic oligonucleotide"
uucaucaccuucuucaggu

SEQ ID NO: 124 - RNA, 23 nt, Artificial Sequence
  source: /note="Description of Artificial Sequence: Synthetic oligonucleotide"
uucugcauccgucucaucaccuu

SEQ ID NO: 125 - RNA, 23 nt, Artificial Sequence
  source: /note="Description of Artificial Sequence: Synthetic oligonucleotide"
ucuucugcauccgucucaucacc

SEQ ID NO: 126 - RNA, 19 nt, Artificial Sequence
  source: /note="Description of Artificial Sequence: Synthetic oligonucleotide"
uucugcauccgucucauca

SEQ ID NO: 127 - RNA, 19 nt, Artificial Sequence
  source: /note="Description of Artificial Sequence: Synthetic oligonucleotide"
ucuucugcauccgucucau

SEQ ID NO: 128 - RNA, 23 nt, Artificial Sequence
  source: /note="Description of Artificial Sequence: Synthetic oligonucleotide"
uccaucuccuucugcauccgucu

SEQ ID NO: 129 - RNA, 19 nt, Artificial Sequence
  source: /note="Description of Artificial Sequence: Synthetic oligonucleotide"
uccaucuccuucugcaucc

SEQ ID NO: 130 - RNA, 23 nt, Artificial Sequence
  source: /note="Description of Artificial Sequence: Synthetic oligonucleotide"
uacacuggccucuucaugggucu

SEQ ID NO: 131 - RNA, 19 nt, Artificial Sequence
  source: /note="Description of Artificial Sequence: Synthetic oligonucleotide"
uacacuggccucuucaugg

SEQ ID NO: 132 - RNA, 23 nt, Artificial Sequence
  source: /note="Description of Artificial Sequence: Synthetic oligonucleotide"
uugggcagcaucuucacacuggc

SEQ ID NO: 133 - RNA, 19 nt, Artificial Sequence
  source: /note="Description of Artificial Sequence: Synthetic oligonucleotide"
uugggcagcaucuucacac

SEQ ID NO: 134 - RNA, 23 nt, Artificial Sequence
  source: /note="Description of Artificial Sequence: Synthetic oligonucleotide"
uucaccuucucccaccuucacca

SEQ ID NO: 135 - RNA, 19 nt, Artificial Sequence
  source: /note="Description of Artificial Sequence: Synthetic oligonucleotide"
uucaccuucucccaccuuc

SEQ ID NO: 136 - RNA, 23 nt, Artificial Sequence
  source: /note="Description of Artificial Sequence: Synthetic oligonucleotide"
ugguguuuggucuucacgcucca

SEQ ID NO: 137 - RNA, 19 nt, Artificial Sequence
  source: /note="Description of Artificial Sequence: Synthetic oligonucleotide"
ugguguuuggucuucacgc

SEQ ID NO: 138 - RNA, 23 nt, Artificial Sequence
  source: /note="Description of Artificial Sequence: Synthetic oligonucleotide"
uacaucugguguuuggucuucac

SEQ ID NO: 139 - RNA, 19 nt, Artificial Sequence
  source: /note="Description of Artificial Sequence: Synthetic oligonucleotide"
uacaucugguguuuggucu

SEQ ID NO: 140 - RNA, 23 nt, Artificial Sequence
  source: /note="Description of Artificial Sequence: Synthetic oligonucleotide"
uugaugcuuguccaggaagucgg

SEQ ID NO: 141 - RNA, 23 nt, Artificial Sequence
  source: /note="Description of Artificial Sequence: Synthetic oligonucleotide"
aucugaugcuuguccaggaaguc

SEQ ID NO: 142 - RNA, 19 nt, Artificial Sequence
  source: /note="Description of Artificial Sequence: Synthetic oligonucleotide"
uugaugcuuguccaggaag

SEQ ID NO: 143 - RNA, 19 nt, Artificial Sequence
  source: /note="Description of Artificial Sequence: Synthetic oligonucleotide"
aucugaugcuuguccagga

SEQ ID NO: 144 - RNA, 23 nt, Artificial Sequence
  source: /note="Description of Artificial Sequence: Synthetic oligonucleotide"
uucaucugaugcuuguccaggaa

SEQ ID NO: 145 - RNA, 23 nt, Artificial Sequence
  source: /note="Description of Artificial Sequence: Synthetic oligonucleotide"
uuucaucugaugcuuguccagga

SEQ ID NO: 146 - RNA, 19 nt, Artificial Sequence
  source: /note="Description of Artificial Sequence: Synthetic oligonucleotide"
uucaucugaugcuugucca

SEQ ID NO: 147 - RNA, 19 nt, Artificial Sequence
  source: /note="Description of Artificial Sequence: Synthetic oligonucleotide"
uuucaucugaugcuugucc

SEQ ID NO: 148 - RNA, 23 nt, Artificial Sequence
  source: /note="Description of Artificial Sequence: Synthetic oligonucleotide"
uuuaucgaugucuucgugccuca

SEQ ID NO: 149 - RNA, 19 nt, Artificial Sequence
  source: /note="Description of Artificial Sequence: Synthetic oligonucleotide"
uuuaucgaugucuucgugc

SEQ ID NO: 150 - RNA, 23 nt, Artificial Sequence
  source: /note="Description of Artificial Sequence: Synthetic oligonucleotide"
uaaggaugcccuuaucgaugucu

SEQ ID NO: 151 - RNA, 19 nt, Artificial Sequence
  source: /note="Description of Artificial Sequence: Synthetic oligonucleotide"
uaaggaugcccuuaucgau

SEQ ID NO: 152 - RNA, 23 nt, Artificial Sequence
  source: /note="Description of Artificial Sequence: Synthetic oligonucleotide"
uccuugaagcccuugguccaguu

SEQ ID NO: 153 - RNA, 19 nt, Artificial Sequence
  source: /note="Description of Artificial Sequence: Synthetic oligonucleotide"
uccuugaagcccuuggucc

SEQ ID NO: 154 - RNA, 23 nt, Artificial Sequence
  source: /note="Description of Artificial Sequence: Synthetic oligonucleotide"
ucuccugaggccuugaagcccuu

SEQ ID NO: 155 - RNA, 19 nt, Artificial Sequence
  source: /note="Description of Artificial Sequence: Synthetic oligonucleotide"
ucuccugaggccuugaagc

SEQ ID NO: 156 - RNA, 23 nt, Artificial Sequence
  source: /note="Description of Artificial Sequence: Synthetic oligonucleotide"
uauuguucccuucugcuccugag

SEQ ID NO: 157 - RNA, 23 nt, Artificial Sequence
  source: /note="Description of Artificial Sequence: Synthetic oligonucleotide"
uacauuguucccuucugcuccug

SEQ ID NO: 158 - RNA, 19 nt, Artificial Sequence
  source: /note="Description of Artificial Sequence: Synthetic oligonucleotide"
uauuguucccuucugcucc

SEQ ID NO: 159 - RNA, 23 nt, Artificial Sequence
  source: /note="Description of Artificial Sequence: Synthetic oligonucleotide"
ugacauuguucccuucugcuccu

SEQ ID NO: 160 - RNA, 19 nt, Artificial Sequence
  source: /note="Description of Artificial Sequence: Synthetic oligonucleotide"
uacauuguucccuucugcu

SEQ ID NO: 161 - RNA, 19 nt, Artificial Sequence
  source: /note="Description of Artificial Sequence: Synthetic oligonucleotide"
ugacauuguucccuucugc

SEQ ID NO: 162 - RNA, 23 nt, Artificial Sequence
  source: /note="Description of Artificial Sequence: Synthetic oligonucleotide"
uaccacauccauuucaaaguccc

SEQ ID NO: 163 - RNA, 23 nt, Artificial Sequence
  source: /note="Description of Artificial Sequence: Synthetic oligonucleotide"
uccaccacauccauuucaaaguc

SEQ ID NO: 164 - RNA, 19 nt, Artificial Sequence
  source: /note="Description of Artificial Sequence: Synthetic oligonucleotide"
uaccacauccauuucaaag

SEQ ID NO: 165 - RNA, 19 nt, Artificial Sequence
  source: /note="Description of Artificial Sequence: Synthetic oligonucleotide"
uccaccacauccauuucaa

SEQ ID NO: 166 - RNA, 23 nt, Artificial Sequence
  source: /note="Description of Artificial Sequence: Synthetic oligonucleotide"
auugccaccacauccauuucaaa

SEQ ID NO: 167 - RNA, 19 nt, Artificial Sequence
  source: /note="Description of Artificial Sequence: Synthetic oligonucleotide"
auugccaccacauccauuu

SEQ ID NO: 168 - RNA, 23 nt, Artificial Sequence
  source: /note="Description of Artificial Sequence: Synthetic oligonucleotide"
uaccauugccaccacauccauuu

SEQ ID NO: 169 - RNA, 23 nt, Artificial Sequence
  source: /note="Description of Artificial Sequence: Synthetic oligonucleotide"
uaccauugccaccacauccaucu

SEQ ID NO: 170 - RNA, 23 nt, Artificial Sequence
  source: /note="Description of Artificial Sequence: Synthetic oligonucleotide"
uucaccauugccaccacauccau

SEQ ID NO: 171 - RNA, 19 nt, Artificial Sequence
  source: /note="Description of Artificial Sequence: Synthetic oligonucleotide"
uaccauugccaccacaucc

SEQ ID NO: 172 - RNA, 19 nt, Artificial Sequence
  source: /note="Description of Artificial Sequence: Synthetic oligonucleotide"
uucaccauugccaccacau

SEQ ID NO: 173 - RNA, 23 nt, Artificial Sequence
  source: /note="Description of Artificial Sequence: Synthetic oligonucleotide"
uaccgugucauucaccauugcca

SEQ ID NO: 174 - RNA, 19 nt, Artificial Sequence
  source: /note="Description of Artificial Sequence: Synthetic oligonucleotide"
uaccgugucauucaccauu

SEQ ID NO: 175 - RNA, 23 nt, Artificial Sequence
  source: /note="Description of Artificial Sequence: Synthetic oligonucleotide"
uaucaugccgaccucgcacugau

SEQ ID NO: 176 - RNA, 19 nt, Artificial Sequence
  source: /note="Description of Artificial Sequence: Synthetic oligonucleotide"
uaucaugccgaccucgcac

SEQ ID NO: 177 - RNA, 23 nt, Artificial Sequence
  source: /note="Description of Artificial Sequence: Synthetic oligonucleotide"
uauucugcaucuccuccauguag

SEQ ID NO: 178 - RNA, 19 nt, Artificial Sequence
  source: /note="Description of Artificial Sequence: Synthetic oligonucleotide"
uauucugcaucuccuccau

SEQ ID NO: 179 - RNA, 23 nt, Artificial Sequence
  source: /note="Description of Artificial Sequence: Synthetic oligonucleotide"
accagcuccacauucugcaucuc

SEQ ID NO: 180 - RNA, 19 nt, Artificial Sequence
  source: /note="Description of Artificial Sequence: Synthetic oligonucleotide"
accagcuccacauucugca

SEQ ID NO: 181 - RNA, 23 nt, Artificial Sequence
  source: /note="Description of Artificial Sequence: Synthetic oligonucleotide"
uuuugcagagcucucguccacca

SEQ ID NO: 182 - RNA, 19 nt, Artificial Sequence
  source: /note="Description of Artificial Sequence: Synthetic oligonucleotide"
uuuugcagagcucucgucc

SEQ ID NO: 183 - RNA, 23 nt, Artificial Sequence
  source: /note="Description of Artificial Sequence: Synthetic oligonucleotide"
uaccagcucgcccauguacuugc

SEQ ID NO: 184 - RNA, 19 nt, Artificial Sequence
  source: /note="Description of Artificial Sequence: Synthetic oligonucleotide"
uaccagcucgcccauguac

SEQ ID NO: 185 - RNA, 23 nt, Artificial Sequence
  source: /note="Description of Artificial Sequence: Synthetic oligonucleotide"
uagguuuucguccacgagccuga

SEQ ID NO: 186 - RNA, 19 nt, Artificial Sequence
  source: /note="Description of Artificial Sequence: Synthetic oligonucleotide"
uagguuuucguccacgagc

SEQ ID NO: 187 - RNA, 23 nt, Artificial Sequence
  source: /note="Description of Artificial Sequence: Synthetic oligonucleotide"
aagagcagguuuucguccacgag

SEQ ID NO: 188 - RNA, 23 nt, Artificial Sequence
  source: /note="Description of Artificial Sequence: Synthetic oligonucleotide"
uaagagcagguuuucguccacga

SEQ ID NO: 189 - RNA, 19 nt, Artificial Sequence
  source: /note="Description of Artificial Sequence: Synthetic oligonucleotide"
aagagcagguuuucgucca

SEQ ID NO: 190 - RNA, 19 nt, Artificial Sequence
  source: /note="Description of Artificial Sequence: Synthetic oligonucleotide"
uaagagcagguuuucgucc

SEQ ID NO: 191 - RNA, 23 nt, Artificial Sequence
  source: /note="Description of Artificial Sequence: Synthetic oligonucleotide"
uauguuguagaucugcuugcggu

SEQ ID NO: 192 - RNA, 19 nt, Artificial Sequence
  source: /note="Description of Artificial Sequence: Synthetic oligonucleotide"
uauguuguagaucugcuug

SEQ ID NO: 193 - RNA, 23 nt, Artificial Sequence
  source: /note="Description of Artificial Sequence: Synthetic oligonucleotide"
uaugaaggugaucucgcagcugg

SEQ ID NO: 194 - RNA, 19 nt, Artificial Sequence
  source: /note="Description of Artificial Sequence: Synthetic oligonucleotide"
uaugaaggugaucucgcag

SEQ ID NO: 195 - RNA, 23 nt, Artificial Sequence
  source: /note="Description of Artificial Sequence: Synthetic oligonucleotide"
uaagaaaauggccaggacugggu

SEQ ID NO: 196 - RNA, 19 nt, Artificial Sequence
  source: /note="Description of Artificial Sequence: Synthetic oligonucleotide"
uaagaaaauggccaggacu

SEQ ID NO: 197 - RNA, 23 nt, Artificial Sequence
  source: /note="Description of Artificial Sequence: Synthetic oligonucleotide"
agaaucacaagccacucagugau

SEQ ID NO: 198 - RNA, 19 nt, Artificial Sequence
  source: /note="Description of Artificial Sequence: Synthetic oligonucleotide"
agaaucacaagccacucag

SEQ ID NO: 199 - RNA, 23 nt, Artificial Sequence
  source: /note="Description of Artificial Sequence: Synthetic oligonucleotide"
auguuuaaaacuuuuaacauuuu

SEQ ID NO: 200 - RNA, 19 nt, Artificial Sequence
  source: /note="Description of Artificial Sequence: Synthetic oligonucleotide"
auguuuaaaacuuuuaaca

SEQ ID NO: 201 - RNA, 19 nt, Artificial Sequence
  source: /note="Description of Artificial Sequence: Synthetic oligonucleotide"
uauguuguucccuucugcu

SEQ ID NO: 202 - RNA, 23 nt, Artificial Sequence
  source: /note="Description of Artificial Sequence: Synthetic oligonucleotide"
uauguuguucccuucugcuccgg

SEQ ID NO: 203 - RNA, 19 nt, Artificial Sequence
  source: /note="Description of Artificial Sequence: Synthetic oligonucleotide"
uuugauagcaucucggaga

SEQ ID NO: 204 - RNA, 23 nt, Artificial Sequence
  source: /note="Description of Artificial Sequence: Synthetic oligonucleotide"
uuugauagcaucucggagaaguc

SEQ ID NO: 205 - RNA, 19 nt, Artificial Sequence
  source: /note="Description of Artificial Sequence: Synthetic oligonucleotide"
auugccaccacauccaucu

SEQ ID NO: 206 - RNA, 23 nt, Artificial Sequence
  source: /note="Description of Artificial Sequence: Synthetic oligonucleotide"
auugccaccacauccaucucaaa

SEQ ID NO: 207 - RNA, 19 nt, Artificial Sequence
  source: /note="Description of Artificial Sequence: Synthetic oligonucleotide"
aaugaaggugauuucgcag

SEQ ID NO: 208 - RNA, 23 nt, Artificial Sequence
  source: /note="Description of Artificial Sequence: Synthetic oligonucleotide"
aaugaaggugauuucgcaguugg

SEQ ID NO: 209 - RNA, 21 nt, Artificial Sequence
  source: /note="Description of Artificial Sequence: Synthetic oligonucleotide"
gaggaccugaagaaggugaua

SEQ ID NO: 210 - RNA, 21 nt, Artificial Sequence
  source: /note="Description of Artificial Sequence: Synthetic oligonucleotide"
ggaccugaagaaggugaugaa

SEQ ID NO: 211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaccugaagaaggugauatt

SEQ ID NO: 212 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugaagaaggugaugaatt

SEQ ID NO: 213 - RNA, 21 nt, Artificial Sequence
  source: /note="Description of Artificial Sequence: Synthetic oligonucleotide"
ggugaugagacggaugcagaa

SEQ ID NO: 214 - RNA, 21 nt, Artificial Sequence
  source: /note="Description of Artificial Sequence: Synthetic oligonucleotide"
ugaugagacggaugcagaaga

SEQ ID NO: 215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugagacggaugcagaatt

SEQ ID NO: 216 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagacggaugcagaagatt

SEQ ID NO: 217 - RNA, 21 nt, Artificial Sequence
  source: /note="Description of Artificial Sequence: Synthetic oligonucleotide"
acggaugcagaaggagaugga

SEQ ID NO: 218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugcagaaggagauggatt

SEQ ID NO: 219 - RNA, 21 nt, Artificial Sequence
  source: /note="Description of Artificial Sequence: Synthetic oligonucleotide"
acccaugaagaggccagugua

SEQ ID NO: 220 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaugaagaggccaguguatt

SEQ ID NO: 221 - RNA, 21 nt, Artificial Sequence
  source: /note="Description of Artificial Sequence: Synthetic oligonucleotide"
cagugugaagaugcugcccaa

SEQ ID NO: 222 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugugaagaugcugcccaatt

SEQ ID NO: 223 - RNA, 21 nt, Artificial Sequence
  source: /note="Description of Artificial Sequence: Synthetic oligonucleotide"
gugaaggugggagaaggugaa

SEQ ID NO: 224 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggugggagaaggugaatt

SEQ ID NO: 225 - RNA, 21 nt, Artificial Sequence
  source: /note="Description of Artificial Sequence: Synthetic oligonucleotide"
gagcgugaagaccaaacacca

SEQ ID NO: 226 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgugaagaccaaacaccatt

SEQ ID NO: 227 - RNA, 21 nt, Artificial Sequence
  source: /note="Description of Artificial Sequence: Synthetic oligonucleotide"
gaagaccaaacaccagaugua

SEQ ID NO: 228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccaaacaccagauguatt

SEQ ID NO: 229 - RNA, 21 nt, Artificial Sequence
  source: /note="Description of Artificial Sequence: Synthetic oligonucleotide"
gacuuccuggacaagcaucaa

SEQ ID NO: 230 - RNA, 21 nt, Artificial Sequence
  source: /note="Description of Artificial Sequence: Synthetic oligonucleotide"
cuuccuggacaagcaucagau

SEQ ID NO: 231 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccuggacaagcaucaatt

SEQ ID NO: 232 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuggacaagcaucagautt

SEQ ID NO: 233 - RNA, 21 nt, Artificial Sequence
  source: /note="Description of Artificial Sequence: Synthetic oligonucleotide"
ccuggacaagcaucagaugaa

SEQ ID NO: 234 - RNA, 21 nt, Artificial Sequence
  source: /note="Description of Artificial Sequence: Synthetic oligonucleotide"
cuggacaagcaucagaugaaa

SEQ ID NO: 235 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacaagcaucagaugaatt

SEQ ID NO: 236 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacaagcaucagaugaaatt

SEQ ID NO: 237 - RNA, 21 nt, Artificial Sequence
  source: /note="Description of Artificial Sequence: Synthetic oligonucleotide"
aggcacgaagacaucgauaaa

SEQ ID NO: 238 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacgaagacaucgauaaatt

SEQ ID NO: 239 - RNA, 21 nt, Artificial Sequence
  source: /note="Description of Artificial Sequence: Synthetic oligonucleotide"
acaucgauaagggcauccuua

SEQ ID NO: 240 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgauaagggcauccuuatt

SEQ ID NO: 241 - RNA, 21 nt, Artificial Sequence
  source: /note="Description of Artificial Sequence: Synthetic oligonucleotide"
cuggaccaagggcuucaagga

SEQ ID NO: 242 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaccaagggcuucaaggatt

SEQ ID NO: 243 - RNA, 21 nt, Artificial Sequence
  source: /note="Description of Artificial Sequence: Synthetic oligonucleotide"
gggcuucaaggccucaggaga

SEQ ID NO: 244 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaaggccucaggagatt

SEQ ID NO: 245 - RNA, 21 nt, Artificial Sequence
  source: /note="Description of Artificial Sequence: Synthetic oligonucleotide"
caggagcagaagggaacaaua

SEQ ID NO: 246 - RNA, 21 nt, Artificial Sequence
  source: /note="Description of Artificial Sequence: Synthetic oligonucleotide"
ggagcagaagggaacaaugua

SEQ ID NO: 247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagcagaagggaacaauatt

SEQ ID NO: 248 - RNA, 21 nt, Artificial Sequence
  source: /note="Description of Artificial Sequence: Synthetic oligonucleotide"
gagcagaagggaacaauguca

SEQ ID NO: 249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaagggaacaauguatt

SEQ ID NO: 250 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaagggaacaaugucatt

SEQ ID NO: 251 - RNA, 21 nt, Artificial Sequence
  source: /note="Description of Artificial Sequence: Synthetic oligonucleotide"
gacuuugaaauggauguggua

SEQ ID NO: 252 - RNA, 21 nt, Artificial Sequence
  source: /note="Description of Artificial Sequence: Synthetic oligonucleotide"
cuuugaaauggauguggugga

SEQ ID NO: 253 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugaaauggaugugguatt

SEQ ID NO: 254 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaauggaugugguggatt

SEQ ID NO: 255 - RNA, 21 nt, Artificial Sequence
  source: /note="Description of Artificial Sequence: Synthetic oligonucleotide"
ugaaauggaugugguggcaau

SEQ ID NO: 256 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauggaugugguggcaautt

SEQ ID NO: 257 - RNA, 21 nt, Artificial Sequence
  source: /note="Description of Artificial Sequence: Synthetic oligonucleotide"
auggaugugguggcaauggua

SEQ ID NO: 258 - RNA, 21 nt, Artificial Sequence
  source: /note="Description of Artificial Sequence: Synthetic oligonucleotide"
auggaugugguggcaauggua

SEQ ID NO: 259 - RNA, 21 nt, Artificial Sequence
  source: /note="Description of Artificial Sequence: Synthetic oligonucleotide"
ggaugugguggcaauggugaa

SEQ ID NO: 260 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugugguggcaaugguatt

SEQ ID NO: 261 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugguggcaauggugaatt

SEQ ID NO: 262 - RNA, 21 nt, Artificial Sequence
  source: /note="Description of Artificial Sequence: Synthetic oligonucleotide"
gcaauggugaaugacacggua

SEQ ID NO: 263 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauggugaaugacacgguatt

SEQ ID NO: 264 - RNA, 21 nt, Artificial Sequence
  source: /note="Description of Artificial Sequence: Synthetic oligonucleotide"
cagugcgaggucggcaugaua

SEQ ID NO: 265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcgaggucggcaugauatt

SEQ ID NO: 266 - RNA, 21 nt, Artificial Sequence
  source: /note="Description of Artificial Sequence: Synthetic oligonucleotide"
acauggaggagaugcagaaua

SEQ ID NO: 267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaggagaugcagaauatt

SEQ ID NO: 268 - RNA, 21 nt, Artificial Sequence
  source: /note="Description of Artificial Sequence: Synthetic oligonucleotide"
gaugcagaauguggagcuggu

SEQ ID NO: 269 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagaauguggagcuggutt

SEQ ID NO: 270 - RNA, 21 nt, Artificial Sequence
  source: /note="Description of Artificial Sequence: Synthetic oligonucleotide"
guggacgagagcucugcaaaa

SEQ ID NO: 271 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacgagagcucugcaaaatt

SEQ ID NO: 272 - RNA, 21 nt, Artificial Sequence
  source: /note="Description of Artificial Sequence: Synthetic oligonucleotide"
aaguacaugggcgagcuggua

SEQ ID NO: 273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guacaugggcgagcugguatt

SEQ ID NO: 274 - RNA, 21 nt, Artificial Sequence
  source: /note="Description of Artificial Sequence: Synthetic oligonucleotide"
aggcucguggacgaaaaccua

SEQ ID NO: 275 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucguggacgaaaaccuatt

SEQ ID NO: 276 - RNA, 21 nt, Artificial Sequence
  source: /note="Description of Artificial Sequence: Synthetic oligonucleotide"
cguggacgaaaaccugcucuu

SEQ ID NO: 277 - RNA, 21 nt, Artificial Sequence
  source: /note="Description of Artificial Sequence: Synthetic oligonucleotide"
guggacgaaaaccugcucuua

SEQ ID NO: 278 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacgaaaaccugcucuutt

SEQ ID NO: 279 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacgaaaaccugcucuuatt

SEQ ID NO: 280 - RNA, 21 nt, Artificial Sequence
  source: /note="Description of Artificial Sequence: Synthetic oligonucleotide"
cgcaagcagaucuacaacaua

SEQ ID NO: 281 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagcagaucuacaacauatt

SEQ ID NO: 282 - RNA, 21 nt, Artificial Sequence
  source: /note="Description of Artificial Sequence: Synthetic oligonucleotide"
agcugcgagaucaccuucaua

SEQ ID NO: 283 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcgagaucaccuucauatt

SEQ ID NO: 284 - RNA, 21 nt, Artificial Sequence
  source: /note="Description of Artificial Sequence: Synthetic oligonucleotide"
ccaguccuggccauuuucuua

SEQ ID NO: 285 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguccuggccauuuucuuatt

SEQ ID NO: 286 - RNA, 21 nt, Artificial Sequence
  source: /note="Description of Artificial Sequence: Synthetic oligonucleotide"
cacugaguggcuugugauucu

SEQ ID NO: 287 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaguggcuugugauucutt

SEQ ID NO: 288 - RNA, 21 nt, Artificial Sequence
  source: /note="Description of Artificial Sequence: Synthetic oligonucleotide"
aauguuaaaaguuuuaaacau

SEQ ID NO: 289 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuaaaaguuuuaaacautt

SEQ ID NO: 290 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaagggaacaacauatt

SEQ ID NO: 291 - RNA, 21 nt, Artificial Sequence
  source: /note="Description of Artificial Sequence: Synthetic oligonucleotide"
ggagcagaagggaacaacaua

SEQ ID NO: 292 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccgagaugcuaucaaatt

SEQ ID NO: 293 - RNA, 21 nt, Artificial Sequence
  source: /note="Description of Artificial Sequence: Synthetic oligonucleotide"
cuucuccgagaugcuaucaaa

SEQ ID NO: 294 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggaugugguggcaautt

SEQ ID NO: 295 - RNA, 21 nt, Artificial Sequence
  source: /note="Description of Artificial Sequence: Synthetic oligonucleotide"
ugagauggaugugguggcaau

SEQ ID NO: 296 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcgaaaucaccuucauutt

SEQ ID NO: 297 - RNA, 21 nt, Artificial Sequence
  source: /note="Description of Artificial Sequence: Synthetic oligonucleotide"
aacugcgaaaucaccuucauu

SEQ ID NO: 298 - RNA, 23 nt, Artificial Sequence
  source: /note="Description of Artificial Sequence: Synthetic oligonucleotide"
uaucaccuucuucagguccuccu

SEQ ID NO: 299 - RNA, 23 nt, Artificial Sequence
  source: /note="Description of Artificial Sequence: Synthetic oligonucleotide"
uucaucaccuucuucagguccuc

SEQ ID NO: 300 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucaccuucuucaggucctt

SEQ ID NO: 301 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaucaccuucuucaggutt

SEQ ID NO: 302 - RNA, 23 nt, Artificial Sequence
  source: /note="Description of Artificial Sequence: Synthetic oligonucleotide"
uucugcauccgucucaucaccuu

SEQ ID NO: 303 - RNA, 23 nt, Artificial Sequence
  source: /note="Description of Artificial Sequence: Synthetic oligonucleotide"
ucuucugcauccgucucaucacc

SEQ ID NO: 304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcauccgucucaucatt

SEQ ID NO: 305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucugcauccgucucautt

SEQ ID NO: 306 - RNA, 23 nt, Artificial Sequence
  source: /note="Description of Artificial Sequence: Synthetic oligonucleotide"
uccaucuccuucugcauccgucu

SEQ ID NO: 307 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucuccuucugcaucctt

SEQ ID NO: 308 - RNA, 23 nt, Artificial Sequence
  source: /note="Description of Artificial Sequence: Synthetic oligonucleotide"
uacacuggccucuucaugggucu

SEQ ID NO: 309 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacacuggccucuucauggtt

SEQ ID NO: 310 - RNA, 23 nt, Artificial Sequence
  source: /note="Description of Artificial Sequence: Synthetic oligonucleotide"
uugggcagcaucuucacacuggc

SEQ ID NO: 311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggcagcaucuucacactt

SEQ ID NO: 312 - RNA, 23 nt, Artificial Sequence
  source: /note="Description of Artificial Sequence: Synthetic oligonucleotide"
uucaccuucucccaccuucacca

SEQ ID NO: 313 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccuucucccaccuuctt

SEQ ID NO: 314 - RNA, 23 nt, Artificial Sequence
  source: /note="Description of Artificial Sequence: Synthetic oligonucleotide"
ugguguuuggucuucacgcucca

SEQ ID NO: 315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguguuuggucuucacgctt

SEQ ID NO: 316 - RNA, 23 nt, Artificial Sequence
  source: /note="Description of Artificial Sequence: Synthetic oligonucleotide"
uacaucugguguuuggucuucac

SEQ ID NO: 317 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucugguguuuggucutt

SEQ ID NO: 318 - RNA, 23 nt, Artificial Sequence
  source: /note="Description of Artificial Sequence: Synthetic oligonucleotide"
uugaugcuuguccaggaagucgg

SEQ ID NO: 319 - RNA, 23 nt, Artificial Sequence
  source: /note="Description of Artificial Sequence: Synthetic oligonucleotide"
aucugaugcuuguccaggaaguc

SEQ ID NO: 320 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaugcuuguccaggaagtt

SEQ ID NO: 321 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugaugcuuguccaggatt

SEQ ID NO: 322 - RNA, 23 nt, Artificial Sequence
  source: /note="Description of Artificial Sequence: Synthetic oligonucleotide"
uucaucugaugcuuguccaggaa

SEQ ID NO: 323 - RNA, 23 nt, Artificial Sequence
  source: /note="Description of Artificial Sequence: Synthetic oligonucleotide"
uuucaucugaugcuuguccagga

SEQ ID NO: 324 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaucugaugcuuguccatt

SEQ ID NO: 325 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaucugaugcuugucctt

SEQ ID NO: 326 - RNA, 23 nt, Artificial Sequence
  source: /note="Description of Artificial Sequence: Synthetic oligonucleotide"
uuuaucgaugucuucgugccuca

SEQ ID NO: 327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaucgaugucuucgugctt

SEQ ID NO: 328 - RNA, 23 nt, Artificial Sequence
  source: /note="Description of Artificial Sequence: Synthetic oligonucleotide"
uaaggaugcccuuaucgaugucu

SEQ ID NO: 329 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaggaugcccuuaucgautt

SEQ ID NO: 330 - RNA, 23 nt, Artificial Sequence
  source: /note="Description of Artificial Sequence: Synthetic oligonucleotide"
uccuugaagcccuugguccaguu

SEQ ID NO: 331 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuugaagcccuuggucctt

SEQ ID NO: 332 - RNA, 23 nt, Artificial Sequence
  source: /note="Description of Artificial Sequence: Synthetic oligonucleotide"
ucuccugaggccuugaagcccuu

SEQ ID NO: 333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccugaggccuugaagctt

SEQ ID NO: 334 - RNA, 23 nt, Artificial Sequence
  source: /note="Description of Artificial Sequence: Synthetic oligonucleotide"
uauuguucccuucugcuccugag

SEQ ID NO: 335 - RNA, 23 nt, Artificial Sequence
  source: /note="Description of Artificial Sequence: Synthetic oligonucleotide"
uacauuguucccuucugcuccug

SEQ ID NO: 336 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuguucccuucugcucctt

SEQ ID NO: 337 - RNA, 23 nt, Artificial Sequence
  source: /note="Description of Artificial Sequence: Synthetic oligonucleotide"
ugacauuguucccuucugcuccu

SEQ ID NO: 338 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacauuguucccuucugcutt

SEQ ID NO: 339 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacauuguucccuucugctt

SEQ ID NO: 340 - RNA, 23 nt, Artificial Sequence
  source: /note="Description of Artificial Sequence: Synthetic oligonucleotide"
uaccacauccauuucaaaguccc

SEQ ID NO: 341 - RNA, 23 nt, Artificial Sequence
  source: /note="Description of Artificial Sequence: Synthetic oligonucleotide"
uccaccacauccauuucaaaguc

SEQ ID NO: 342 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccacauccauuucaaagtt

SEQ ID NO: 343 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaccacauccauuucaatt

SEQ ID NO: 344 - RNA, 23 nt, Artificial Sequence
  source: /note="Description of Artificial Sequence: Synthetic oligonucleotide"
auugccaccacauccauuucaaa

SEQ ID NO: 345 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugccaccacauccauuutt

SEQ ID NO: 346 - RNA, 23 nt, Artificial Sequence
  source: /note="Description of Artificial Sequence: Synthetic oligonucleotide"
uaccauugccaccacauccauuu

SEQ ID NO: 347 - RNA, 23 nt, Artificial Sequence
  source: /note="Description of Artificial Sequence: Synthetic oligonucleotide"
uaccauugccaccacauccaucu

SEQ ID NO: 348 - RNA, 23 nt, Artificial Sequence
  source: /note="Description of Artificial Sequence: Synthetic oligonucleotide"
uucaccauugccaccacauccau

SEQ ID NO: 349 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccauugccaccacaucctt

SEQ ID NO: 350 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccauugccaccacautt

SEQ ID NO: 351 - RNA, 23 nt, Artificial Sequence
  source: /note="Description of Artificial Sequence: Synthetic oligonucleotide"
uaccgugucauucaccauugcca

SEQ ID NO: 352 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccgugucauucaccauutt

SEQ ID NO: 353 - RNA, 23 nt, Artificial Sequence
  source: /note="Description of Artificial Sequence: Synthetic oligonucleotide"
uaucaugccgaccucgcacugau

SEQ ID NO: 354 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucaugccgaccucgcactt

SEQ ID NO: 355 - RNA, 23 nt, Artificial Sequence
  source: /note="Description of Artificial Sequence: Synthetic oligonucleotide"
uauucugcaucuccuccauguag

SEQ ID NO: 356 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucugcaucuccuccautt

SEQ ID NO: 357 - RNA, 23 nt, Artificial Sequence
  source: /note="Description of Artificial Sequence: Synthetic oligonucleotide"
accagcuccacauucugcaucuc

SEQ ID NO: 358 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagcuccacauucugcatt

SEQ ID NO: 359 - RNA, 23 nt, Artificial Sequence
  source: /note="Description of Artificial Sequence: Synthetic oligonucleotide"
uuuugcagagcucucguccacca

SEQ ID NO: 360 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugcagagcucucgucctt

SEQ ID NO: 361 - RNA, 23 nt, Artificial Sequence
  source: /note="Description of Artificial Sequence: Synthetic oligonucleotide"
uaccagcucgcccauguacuugc

SEQ ID NO: 362 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccagcucgcccauguactt

SEQ ID NO: 363 - RNA, 23 nt, Artificial Sequence
  source: /note="Description of Artificial Sequence: Synthetic oligonucleotide"
uagguuuucguccacgagccuga

SEQ ID NO: 364 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagguuuucguccacgagctt

SEQ ID NO: 365 - RNA, 23 nt, Artificial Sequence
  source: /note="Description of Artificial Sequence: Synthetic oligonucleotide"
aagagcagguuuucguccacgag

SEQ ID NO: 366 - RNA, 23 nt, Artificial Sequence
  source: /note="Description of Artificial Sequence: Synthetic oligonucleotide"
uaagagcagguuuucguccacga

SEQ ID NO: 367 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcagguuuucguccatt

SEQ ID NO: 368 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagagcagguuuucgucctt

SEQ ID NO: 369 - RNA, 23 nt, Artificial Sequence
  source: /note="Description of Artificial Sequence: Synthetic oligonucleotide"
uauguuguagaucugcuugcggu

SEQ ID NO: 370 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuguagaucugcuugtt

SEQ ID NO: 371 - RNA, 23 nt, Artificial Sequence
  source: /note="Description of Artificial Sequence: Synthetic oligonucleotide"
uaugaaggugaucucgcagcugg

SEQ ID NO: 372 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugaaggugaucucgcagtt

SEQ ID NO: 373 - RNA, 23 nt, Artificial Sequence
  source: /note="Description of Artificial Sequence: Synthetic oligonucleotide"
uaagaaaauggccaggacugggu

SEQ ID NO: 374 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaaaauggccaggacutt

SEQ ID NO: 375 - RNA, 23 nt, Artificial Sequence
  source: /note="Description of Artificial Sequence: Synthetic oligonucleotide"
agaaucacaagccacucagugau

SEQ ID NO: 376 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaucacaagccacucagtt

SEQ ID NO: 377 - RNA, 23 nt, Artificial Sequence
  source: /note="Description of Artificial Sequence: Synthetic oligonucleotide"
auguuuaaaacuuuuaacauuuu

SEQ ID NO: 378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuuaaaacuuuuaacatt

SEQ ID NO: 379 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuguucccuucugcutt

SEQ ID NO: 380 - RNA, 23 nt, Artificial Sequence
  source: /note="Description of Artificial Sequence: Synthetic oligonucleotide"
uauguuguucccuucugcuccgg

SEQ ID NO: 381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugauagcaucucggagatt

SEQ ID NO: 382 - RNA, 23 nt, Artificial Sequence
  source: /note="Description of Artificial Sequence: Synthetic oligonucleotide"
uuugauagcaucucggagaaguc

SEQ ID NO: 383 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugccaccacauccaucutt

SEQ ID NO: 384 - RNA, 23 nt, Artificial Sequence
  source: /note="Description of Artificial Sequence: Synthetic oligonucleotide"
auugccaccacauccaucucaaa

SEQ ID NO: 385 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugaaggugauuucgcagtt

SEQ ID NO: 386 - RNA, 23 nt, Artificial Sequence
  source: /note="Description of Artificial Sequence: Synthetic oligonucleotide"
aaugaaggugauuucgcaguugg

SEQ ID NO: 387 - RNA, 23 nt, Artificial Sequence
  source: /note="Description of Artificial Sequence: Synthetic oligonucleotide"
aggaggaccugaagaaggugaua

SEQ ID NO: 388 - RNA, 23 nt, Artificial Sequence
  source: /note="Description of Artificial Sequence: Synthetic oligonucleotide"
gaggaccugaagaaggugaugaa

SEQ ID NO: 389 - RNA, 19 nt, Artificial Sequence
  source: /note="Description of Artificial Sequence: Synthetic oligonucleotide"
ggaccugaagaaggugaua

SEQ ID NO: 390 - RNA, 19 nt, Artificial Sequence
  source: /note="Description of Artificial Sequence: Synthetic oligonucleotide"
accugaagaaggugaugaa

SEQ ID NO: 391 - RNA, 23 nt, Artificial Sequence
  source: /note="Description of Artificial Sequence: Synthetic oligonucleotide"
aaggugaugagacggaugcagaa

SEQ ID NO: 392 - RNA, 23 nt, Artificial Sequence
  source: /note="Description of Artificial Sequence: Synthetic oligonucleotide"
ggugaugagacggaugcagaaga

SEQ ID NO: 393 - RNA, 19 nt, Artificial Sequence
  source: /note="Description of Artificial Sequence: Synthetic oligonucleotide"
ugaugagacggaugcagaa

SEQ ID NO: 394 - RNA, 19 nt, Artificial Sequence
  source: /note="Description of Artificial Sequence: Synthetic oligonucleotide"
augagacggaugcagaaga

SEQ ID NO: 395 - RNA, 23 nt, Artificial Sequence
  source: /note="Description of Artificial Sequence: Synthetic oligonucleotide"
agacggaugcagaaggagaugga

SEQ ID NO: 396 - RNA, 19 nt, Artificial Sequence
  source: /note="Description of Artificial Sequence: Synthetic oligonucleotide"
ggaugcagaaggagaugga

SEQ ID NO: 397 - RNA, 23 nt, Artificial Sequence
  source: /note="Description of Artificial Sequence: Synthetic oligonucleotide"
agacccaugaagaggccagugua

SEQ ID NO: 398 - RNA, 19 nt, Artificial Sequence
  source: /note="Description of Artificial Sequence: Synthetic oligonucleotide"
ccaugaagaggccagugua

SEQ ID NO: 399 - RNA, 23 nt, Artificial Sequence
  source: /note="Description of Artificial Sequence: Synthetic oligonucleotide"
gccagugugaagaugcugcccaa

SEQ ID NO: 400 - RNA, 19 nt, Artificial Sequence
  source: /note="Description of Artificial Sequence: Synthetic oligonucleotide"
gugugaagaugcugcccaa

SEQ ID NO: 401 - RNA, 23 nt, Artificial Sequence
  source: /note="Description of Artificial Sequence: Synthetic oligonucleotide"
uggugaaggugggagaaggugaa

SEQ ID NO: 402 - RNA, 19 nt, Artificial Sequence
  source: /note="Description of Artificial Sequence: Synthetic oligonucleotide"
gaaggugggagaaggugaa

SEQ ID NO: 403 - RNA, 23 nt, Artificial Sequence
  source: /note="Description of Artificial Sequence: Synthetic oligonucleotide"
uggagcgugaagaccaaacacca

SEQ ID NO: 404 - RNA, 19 nt, Artificial Sequence
  source: /note="Description of Artificial Sequence: Synthetic oligonucleotide"
gcgugaagaccaaacacca

SEQ ID NO: 405 - RNA, 23 nt, Artificial Sequence
  source: /note="Description of Artificial Sequence: Synthetic oligonucleotide"
gugaagaccaaacaccagaugua

SEQ ID NO: 406 - RNA, 19 nt, Artificial Sequence
  source: /note="Description of Artificial Sequence: Synthetic oligonucleotide"
agaccaaacaccagaugua

SEQ ID NO: 407 - RNA, 23 nt, Artificial Sequence
  source: /note="Description of Artificial Sequence: Synthetic oligonucleotide"
ccgacuuccuggacaagcaucaa

SEQ ID NO: 408 - RNA, 23 nt, Artificial Sequence
  source: /note="Description of Artificial Sequence: Synthetic oligonucleotide"
gacuuccuggacaagcaucagau

SEQ ID NO: 409 - RNA, 19 nt, Artificial Sequence
  source: /note="Description of Artificial Sequence: Synthetic oligonucleotide"
cuuccuggacaagcaucaa

SEQ ID NO: 410 - RNA, 19 nt, Artificial Sequence
  source: /note="Description of Artificial Sequence: Synthetic oligonucleotide"
uccuggacaagcaucagau

SEQ ID NO: 411 - RNA, 23 nt, Artificial Sequence
  source: /note="Description of Artificial Sequence: Synthetic oligonucleotide"
uuccuggacaagcaucagaugaa

SEQ ID NO: 412 - RNA, 23 nt, Artificial Sequence
  source: /note="Description of Artificial Sequence: Synthetic oligonucleotide"
uccuggacaagcaucagaugaaa

SEQ ID NO: 413 - RNA, 19 nt, Artificial Sequence
  source: /note="Description of Artificial Sequence: Synthetic oligonucleotide"
uggacaagcaucagaugaa

SEQ ID NO: 414 - RNA, 19 nt, Artificial Sequence
  source: /note="Description of Artificial Sequence: Synthetic oligonucleotide"
ggacaagcaucagaugaaa

SEQ ID NO: 415 - RNA, 23 nt, Artificial Sequence
  source: /note="Description of Artificial Sequence: Synthetic oligonucleotide"
ugaggcacgaagacaucgauaaa

SEQ ID NO: 416 - RNA, 19 nt, Artificial Sequence
  source: /note="Description of Artificial Sequence: Synthetic oligonucleotide"
gcacgaagacaucgauaaa

SEQ ID NO: 417 - RNA, 23 nt, Artificial Sequence
  source: /note="Description of Artificial Sequence: Synthetic oligonucleotide"
agacaucgauaagggcauccuua

SEQ ID NO: 418 - RNA, 19 nt, Artificial Sequence
  source: /note="Description of Artificial Sequence: Synthetic oligonucleotide"
aucgauaagggcauccuua

SEQ ID NO: 419 - RNA, 23 nt, Artificial Sequence
  source: /note="Description of Artificial Sequence: Synthetic oligonucleotide"
aacuggaccaagggcuucaagga

SEQ ID NO: 420 - RNA, 19 nt, Artificial Sequence
  source: /note="Description of Artificial Sequence: Synthetic oligonucleotide"
ggaccaagggcuucaagga

SEQ ID NO: 421 - RNA, 23 nt, Artificial Sequence
  source: /note="Description of Artificial Sequence: Synthetic oligonucleotide"
aagggcuucaaggccucaggaga

SEQ ID NO: 422 - RNA, 19 nt, Artificial Sequence
  source: /note="Description of Artificial Sequence: Synthetic oligonucleotide"
gcuucaaggccucaggaga

SEQ ID NO: 423 - RNA, 23 nt, Artificial Sequence
  source: /note="Description of Artificial Sequence: Synthetic oligonucleotide"
cucaggagcagaagggaacaaua

SEQ ID NO: 424 - RNA, 23 nt, Artificial Sequence
  source: /note="Description of Artificial Sequence: Synthetic oligonucleotide"
caggagcagaagggaacaaugua

SEQ ID NO: 425 - RNA, 19 nt, Artificial Sequence
  source: /note="Description of Artificial Sequence: Synthetic oligonucleotide"
ggagcagaagggaacaaua

SEQ ID NO: 426 - RNA, 23 nt, Artificial Sequence
  source: /note="Description of Artificial Sequence: Synthetic oligonucleotide"
aggagcagaagggaacaauguca

SEQ ID NO: 427 - RNA, 19 nt, Artificial Sequence
  source: /note="Description of Artificial Sequence: Synthetic oligonucleotide"
agcagaagggaacaaugua

SEQ ID NO: 428 - RNA, 19 nt, Artificial Sequence
  source: /note="Description of Artificial Sequence: Synthetic oligonucleotide"
gcagaagggaacaauguca

SEQ ID NO: 429 - RNA, 23 nt, Artificial Sequence
  source: /note="Description of Artificial Sequence: Synthetic oligonucleotide"
gggacuuugaaauggauguggua

SEQ ID NO: 430 - RNA, 23 nt, Artificial Sequence
  source: /note="Description of Artificial Sequence: Synthetic oligonucleotide"
gacuuugaaauggauguggugga

SEQ ID NO: 431 - RNA, 19 nt, Artificial Sequence
  source: /note="Description of Artificial Sequence: Synthetic oligonucleotide"
cuuugaaauggauguggua

SEQ ID NO: 432 - RNA, 19 nt, Artificial Sequence
  source: /note="Description of Artificial Sequence: Synthetic oligonucleotide"
uugaaauggauguggugga

SEQ ID NO: 433 - RNA, 23 nt, Artificial Sequence
  source: /note="Description of Artificial Sequence: Synthetic oligonucleotide"
uuugaaauggaugugguggcaau

SEQ ID NO: 434 - RNA, 19 nt, Artificial Sequence
  source: /note="Description of Artificial Sequence: Synthetic oligonucleotide"
aaauggaugugguggcaau

SEQ ID NO: 435 - RNA, 23 nt, Artificial Sequence
  source: /note="Description of Artificial Sequence: Synthetic oligonucleotide"
aaauggaugugguggcaauggua

SEQ ID NO: 436 - RNA, 23 nt, Artificial Sequence
  source: /note="Description of Artificial Sequence: Synthetic oligonucleotide"
agauggaugugguggcaauggua

SEQ ID NO: 437 - RNA, 23 nt, Artificial Sequence
  source: /note="Description of Artificial Sequence: Synthetic oligonucleotide"
auggaugugguggcaauggugaa

SEQ ID NO: 438 - RNA, 19 nt, Artificial Sequence
  source: /note="Description of Artificial Sequence: Synthetic oligonucleotide"
ggaugugguggcaauggua

SEQ ID NO: 439 - RNA, 19 nt, Artificial Sequence
  source: /note="Description of Artificial Sequence: Synthetic oligonucleotide"
augugguggcaauggugaa

SEQ ID NO: 440 - RNA, 23 nt, Artificial Sequence
  source: /note="Description of Artificial Sequence: Synthetic oligonucleotide"
uggcaauggugaaugacacggua

SEQ ID NO: 441 - RNA, 19 nt, Artificial Sequence
  source: /note="Description of Artificial Sequence: Synthetic oligonucleotide"
aauggugaaugacacggua

SEQ ID NO: 442 - RNA, 23 nt, Artificial Sequence
  source: /note="Description of Artificial Sequence: Synthetic oligonucleotide"
aucagugcgaggucggcaugaua

SEQ ID NO: 443 - RNA, 19 nt, Artificial Sequence
  source: /note="Description of Artificial Sequence: Synthetic oligonucleotide"
gugcgaggucggcaugaua

SEQ ID NO: 444 - RNA, 23 nt, Artificial Sequence
  source: /note="Description of Artificial Sequence: Synthetic oligonucleotide"
cuacauggaggagaugcagaaua

SEQ ID NO: 445 - RNA, 19 nt, Artificial Sequence
  source: /note="Description of Artificial Sequence: Synthetic oligonucleotide"
auggaggagaugcagaaua

SEQ ID NO: 446 - RNA, 23 nt, Artificial Sequence
  source: /note="Description of Artificial Sequence: Synthetic oligonucleotide"
gagaugcagaauguggagcuggu

SEQ ID NO: 447 - RNA, 19 nt, Artificial Sequence
  source: /note="Description of Artificial Sequence: Synthetic oligonucleotide"
ugcagaauguggagcuggu

SEQ ID NO: 448 - RNA, 23 nt, Artificial Sequence
  source: /note="Description of Artificial Sequence: Synthetic oligonucleotide"
ugguggacgagagcucugcaaaa

SEQ ID NO: 449 - RNA, 19 nt, Artificial Sequence
  source: /note="Description of Artificial Sequence: Synthetic oligonucleotide"
ggacgagagcucugcaaaa

SEQ ID NO: 450 - RNA, 23 nt, Artificial Sequence
  source: /note="Description of Artificial Sequence: Synthetic oligonucleotide"
gcaaguacaugggcgagcuggua

SEQ ID NO: 451 - RNA, 19 nt, Artificial Sequence
  source: /note="Description of Artificial Sequence: Synthetic oligonucleotide"
guacaugggcgagcuggua

SEQ ID NO: 452 - RNA, 23 nt, Artificial Sequence
  source: /note="Description of Artificial Sequence: Synthetic oligonucleotide"
ucaggcucguggacgaaaaccua

SEQ ID NO: 453 - RNA, 19 nt, Artificial Sequence
  source: /note="Description of Artificial Sequence: Synthetic oligonucleotide"
gcucguggacgaaaaccua

SEQ ID NO: 454 - RNA, 23 nt, Artificial Sequence
  source: /note="Description of Artificial Sequence: Synthetic oligonucleotide"
cucguggacgaaaaccugcucuu

SEQ ID NO: 455 - RNA, 23 nt, Artificial Sequence
  source: /note="Description of Artificial Sequence: Synthetic oligonucleotide"
ucguggacgaaaaccugcucuua

SEQ ID NO: 456 - RNA, 19 nt, Artificial Sequence
  source: /note="Description of Artificial Sequence: Synthetic oligonucleotide"
uggacgaaaaccugcucuu

SEQ ID NO: 457 - RNA, 19 nt, Artificial Sequence
  source: /note="Description of Artificial Sequence: Synthetic oligonucleotide"
ggacgaaaaccugcucuua

SEQ ID NO: 458 - RNA, 23 nt, Artificial Sequence
  source: /note="Description of Artificial Sequence: Synthetic oligonucleotide"
accgcaagcagaucuacaacaua

SEQ ID NO: 459 - RNA, 19 nt, Artificial Sequence
  source: /note="Description of Artificial Sequence: Synthetic oligonucleotide"
caagcagaucuacaacaua

SEQ ID NO: 460 - RNA, 23 nt, Artificial Sequence
  source: /note="Description of Artificial Sequence: Synthetic oligonucleotide"
ccagcugcgagaucaccuucaua

SEQ ID NO: 461 - RNA, 19 nt, Artificial Sequence
  source: /note="Description of Artificial Sequence: Synthetic oligonucleotide"
cugcgagaucaccuucaua

SEQ ID NO: 462 - RNA, 23 nt, Artificial Sequence
  source: /note="Description of Artificial Sequence: Synthetic oligonucleotide"
acccaguccuggccauuuucuua

SEQ ID NO: 463 - RNA, 19 nt, Artificial Sequence
  source: /note="Description of Artificial Sequence: Synthetic oligonucleotide"
aguccuggccauuuucuua

SEQ ID NO: 464 - RNA, 23 nt, Artificial Sequence
  source: /note="Description of Artificial Sequence: Synthetic oligonucleotide"
aucacugaguggcuugugauucu

SEQ ID NO: 465 - RNA, 19 nt, Artificial Sequence
  source: /note="Description of Artificial Sequence: Synthetic oligonucleotide"
cugaguggcuugugauucu

SEQ ID NO: 466 - RNA, 23 nt, Artificial Sequence
  source: /note="Description of Artificial Sequence: Synthetic oligonucleotide"
aaaauguuaaaaguuuuaaacau

SEQ ID NO: 467 - RNA, 19 nt, Artificial Sequence
  source: /note="Description of Artificial Sequence: Synthetic oligonucleotide"
uguuaaaaguuuuaaacau

SEQ ID NO: 468 - RNA, 19 nt, Artificial Sequence
  source: /note="Description of Artificial Sequence: Synthetic oligonucleotide"
agcagaagggaacaacaua

SEQ ID NO: 469 - RNA, 23 nt, Artificial Sequence
  source: /note="Description of Artificial Sequence: Synthetic oligonucleotide"
ccggagcagaagggaacaacaua

SEQ ID NO: 470 - RNA, 19 nt, Artificial Sequence
  source: /note="Description of Artificial Sequence: Synthetic oligonucleotide"
ucuccgagaugcuaucaaa

SEQ ID NO: 471 - RNA, 23 nt, Artificial Sequence
  source: /note="Description of Artificial Sequence: Synthetic oligonucleotide"
gacuucuccgagaugcuaucaaa

SEQ ID NO: 472 - RNA, 19 nt, Artificial Sequence
  source: /note="Description of Artificial Sequence: Synthetic oligonucleotide"
agauggaugugguggcaau

SEQ ID NO: 473 - RNA, 23 nt, Artificial Sequence
  source: /note="Description of Artificial Sequence: Synthetic oligonucleotide"
uuugagauggaugugguggcaau

SEQ ID NO: 474 - RNA, 19 nt, Artificial Sequence
  source: /note="Description of Artificial Sequence: Synthetic oligonucleotide"
cugcgaaaucaccuucauu

SEQ ID NO: 475 - RNA, 23 nt, Artificial Sequence
  source: /note="Description of Artificial Sequence: Synthetic oligonucleotide"
ccaacugcgaaaucaccuucauu

SEQ ID NO: 476 - RNA, 19 nt, Artificial Sequence
  source: /note="Description of Artificial Sequence: Synthetic oligonucleotide"
cugccagccucaggcagcu

SEQ ID NO: 477 - RNA, 19 nt, Artificial Sequence
  source: /note="Description of Artificial Sequence: Synthetic oligonucleotide"
ucaggcagcucuccaucca

SEQ ID NO: 478 - RNA, 19 nt, Artificial Sequence
  source: /note="Description of Artificial Sequence: Synthetic oligonucleotide"
ccauccaagcagccguuga

SEQ ID NO: 479 - RNA, 19 nt, Artificial Sequence
  source: /note="Description of Artificial Sequence: Synthetic oligonucleotide"
agccguugcugccacagga

SEQ ID NO: 480 - RNA, 19 nt, Artificial Sequence
  source: /note="Description of Artificial Sequence: Synthetic oligonucleotide"
acaggcgggccuuacgcua

SEQ ID NO: 481 - RNA, 19 nt, Artificial Sequence
  source: /note="Description of Artificial Sequence: Synthetic oligonucleotide"
uuacgcuccaaggcuacaa

SEQ ID NO: 482 - RNA, 19 nt, Artificial Sequence
  source: /note="Description of Artificial Sequence: Synthetic oligonucleotide"
aaggcuacagcaugugcua

SEQ ID NO: 483 - RNA, 19 nt, Artificial Sequence
  source: /note="Description of Artificial Sequence: Synthetic oligonucleotide"
ugugcuaggccucagcaga

SEQ ID NO: 484 - RNA, 19 nt, Artificial Sequence
  source: /note="Description of Artificial Sequence: Synthetic oligonucleotide"
ucagcaggcaggagcaucu

SEQ ID NO: 485 - RNA, 19 nt, Artificial Sequence
  source: /note="Description of Artificial Sequence: Synthetic oligonucleotide"
agcaucucugccucccaaa

SEQ ID NO: 486 - RNA, 19 nt, Artificial Sequence
  source: /note="Description of Artificial Sequence: Synthetic oligonucleotide"
ccucccaaagcaucuaccu

SEQ ID NO: 487 - RNA, 19 nt, Artificial Sequence
  source: /note="Description of Artificial Sequence: Synthetic oligonucleotide"
uagccccucggagagauga

SEQ ID NO: 488 - RNA, 19 nt, Artificial Sequence
  source: /note="Description of Artificial Sequence: Synthetic oligonucleotide"
agagauggcgauggaugua

SEQ ID NO: 489 - RNA, 19 nt, Artificial Sequence
  source: /note="Description of Artificial Sequence: Synthetic oligonucleotide"
uggaugucacaaggagcca

SEQ ID NO: 490 - RNA, 19 nt, Artificial Sequence
  source: /note="Description of Artificial Sequence: Synthetic oligonucleotide"
aggagccaggcccagacaa

SEQ ID NO: 491 - RNA, 19 nt, Artificial Sequence
  source: /note="Description of Artificial Sequence: Synthetic oligonucleotide"
acucugguagagcagauca

SEQ ID NO: 492 - RNA, 19 nt, Artificial Sequence
  source: /note="Description of Artificial Sequence: Synthetic oligonucleotide"
agcagauccuggcagaguu

SEQ ID NO: 493 - RNA, 19 nt, Artificial Sequence
  source: /note="Description of Artificial Sequence: Synthetic oligonucleotide"
cagaguuccagcugcagga

SEQ ID NO: 494 - RNA, 19 nt, Artificial Sequence
  source: /note="Description of Artificial Sequence: Synthetic oligonucleotide"
agcugcaggaggaggaccu

SEQ ID NO: 495 - RNA, 19 nt, Artificial Sequence
  source: /note="Description of Artificial Sequence: Synthetic oligonucleotide"
aggaccugaagaaggugau

SEQ ID NO: 496 - RNA, 19 nt, Artificial Sequence
  source: /note="Description of Artificial Sequence: Synthetic oligonucleotide"
aaggugaugagacggauga

SEQ ID NO: 497 - RNA, 19 nt, Artificial Sequence
  source: /note="Description of Artificial Sequence: Synthetic oligonucleotide"
cggaugcagaaggagauga

SEQ ID NO: 498 - RNA, 19 nt, Artificial Sequence
  source: /note="Description of Artificial Sequence: Synthetic oligonucleotide"
aaggagauggaccgcggca

SEQ ID NO: 499 - RNA, 19 nt, Artificial Sequence
  source: /note="Description of Artificial Sequence: Synthetic oligonucleotide"
cgcggccugaggcuggaga

SEQ ID NO: 500 - RNA, 19 nt, Artificial Sequence
  source: /note="Description of Artificial Sequence: Synthetic oligonucleotide"
cuggagacccaugaagaga

SEQ ID NO: 501 - RNA, 19 nt, Artificial Sequence
  source: /note="Description of Artificial Sequence: Synthetic oligonucleotide"
caugaagaggccaguguga

SEQ ID NO: 502 - RNA, 19 nt, Artificial Sequence
  source: /note="Description of Artificial Sequence: Synthetic oligonucleotide"
cagugugaagaugcugcca

SEQ ID NO: 503 - RNA, 19 nt, Artificial Sequence
  source: /note="Description of Artificial Sequence: Synthetic oligonucleotide"
ugcugcccaccuacgugca

SEQ ID NO: 504 - RNA, 19 nt, Artificial Sequence
  source: /note="Description of Artificial Sequence: Synthetic oligonucleotide"
uacgugcgcuccaccccaa

SEQ ID NO: 505 - RNA, 19 nt, Artificial Sequence
  source: /note="Description of Artificial Sequence: Synthetic oligonucleotide"
accccagaaggcucagaaa

SEQ ID NO: 506 - RNA, 19 nt, Artificial Sequence
  source: /note="Description of Artificial Sequence: Synthetic oligonucleotide"
ucagaagucggggacuuca

SEQ ID NO: 507 - RNA, 19 nt, Artificial Sequence
  source: /note="Description of Artificial Sequence: Synthetic oligonucleotide"
ggggacuuccucucccuga

SEQ ID NO: 508 - RNA, 19 nt, Artificial Sequence
  source: /note="Description of Artificial Sequence: Synthetic oligonucleotide"
ucccuggaccuggguggca

SEQ ID NO: 509 - RNA, 19 nt, Artificial Sequence
  source: /note="Description of Artificial Sequence: Synthetic oligonucleotide"
uggguggcacuaacuucaa

SEQ ID NO: 510 - RNA, 19 nt, Artificial Sequence
  source: /note="Description of Artificial Sequence: Synthetic oligonucleotide"
acuucagggugaugcuggu

SEQ ID NO: 511 - RNA, 19 nt, Artificial Sequence
  source: /note="Description of Artificial Sequence: Synthetic oligonucleotide"
aggugggagaaggugagga

SEQ ID NO: 512 - RNA, 19 nt, Artificial Sequence
  source: /note="Description of Artificial Sequence: Synthetic oligonucleotide"
caguggagcgugaagacca

SEQ ID NO: 513 - RNA, 19 nt, Artificial Sequence
  source: /note="Description of Artificial Sequence: Synthetic oligonucleotide"
ccagauguacuccauccca

SEQ ID NO: 514 - RNA, 19 nt, Artificial Sequence
  source: /note="Description of Artificial Sequence: Synthetic oligonucleotide"
accggcacugcugagauga

SEQ ID NO: 515 - RNA, 19 nt, Artificial Sequence
  source: /note="Description of Artificial Sequence: Synthetic oligonucleotide"
agaugcucuucgacuacau

SEQ ID NO: 516 - RNA, 19 nt, Artificial Sequence
  source: /note="Description of Artificial Sequence: Synthetic oligonucleotide"
ucgacuacaucucugagua

SEQ ID NO: 517 - RNA, 19 nt, Artificial Sequence
  source: /note="Description of Artificial Sequence: Synthetic oligonucleotide"
ucugagugcaucuccgacu

SEQ ID NO: 518 - RNA, 19 nt, Artificial Sequence
  source: /note="Description of Artificial Sequence: Synthetic oligonucleotide"
uccgacuuccuggacaaga

SEQ ID NO: 519 - RNA, 19 nt, Artificial Sequence
  source: /note="Description of Artificial Sequence: Synthetic oligonucleotide"
gacaagcaucagaugaaac

SEQ ID NO: 520 - RNA, 19 nt, Artificial Sequence
  source: /note="Description of Artificial Sequence: Synthetic oligonucleotide"
agaugaaacacaagaagcu

SEQ ID NO: 521 - RNA, 19 nt, Artificial Sequence
  source: /note="Description of Artificial Sequence: Synthetic oligonucleotide"
agaagcugccccugggcuu

SEQ ID NO: 522 - RNA, 19 nt, Artificial Sequence
  source: /note="Description of Artificial Sequence: Synthetic oligonucleotide"
ccugggcuucaccuucuca

SEQ ID NO: 523 - RNA, 19 nt, Artificial Sequence
  source: /note="Description of Artificial Sequence: Synthetic oligonucleotide"
accuucuccuuuccuguga

SEQ ID NO: 524 - RNA, 19 nt, Artificial Sequence
  source: /note="Description of Artificial Sequence: Synthetic oligonucleotide"
cugugaggcacgaagacau

SEQ ID NO: 525 - RNA, 19 nt, Artificial Sequence
  source: /note="Description of Artificial Sequence: Synthetic oligonucleotide"
gaagacaucgauaagggca

SEQ ID NO: 526 - RNA, 19 nt, Artificial Sequence
  source: /note="Description of Artificial Sequence: Synthetic oligonucleotide"
gauaagggcauccuucuca

SEQ ID NO: 527 - RNA, 19 nt, Artificial Sequence
  source: /note="Description of Artificial Sequence: Synthetic oligonucleotide"
uucucaacuggaccaagga

SEQ ID NO: 528 - RNA, 19 nt, Artificial Sequence
  source: /note="Description of Artificial Sequence: Synthetic oligonucleotide"
accaagggcuucaaggccu

SEQ ID NO: 529 - RNA, 19 nt, Artificial Sequence
  source: /note="Description of Artificial Sequence: Synthetic oligonucleotide"
caaggccucaggagcagaa

SEQ ID NO: 530 - RNA, 19 nt, Artificial Sequence
  source: /note="Description of Artificial Sequence: Synthetic oligonucleotide"
aggagcagaagggaacaau

SEQ ID NO: 531 - RNA, 19 nt, Artificial Sequence
  source: /note="Description of Artificial Sequence: Synthetic oligonucleotide"
aacaaugucguggggcuua

SEQ ID NO: 532 - RNA, 19 nt, Artificial Sequence
  source: /note="Description of Artificial Sequence: Synthetic oligonucleotide"
uggggcuucugcgagacga

SEQ ID NO: 533 - RNA, 19 nt, Artificial Sequence
  source: /note="Description of Artificial Sequence: Synthetic oligonucleotide"
cgagacgcuaucaaacgga

SEQ ID NO: 534 - RNA, 19 nt, Artificial Sequence
  source: /note="Description of Artificial Sequence: Synthetic oligonucleotide"
aaacggagaggggacuuua

SEQ ID NO: 535 - RNA, 19 nt, Artificial Sequence
  source: /note="Description of Artificial Sequence: Synthetic oligonucleotide"
gggacuuugaaauggaugu

SEQ ID NO: 536 - RNA, 19 nt, Artificial Sequence
  source: /note="Description of Artificial Sequence: Synthetic oligonucleotide"
gcaauggugaaugacacga

SEQ ID NO: 537 - RNA, 19 nt, Artificial Sequence
  source: /note="Description of Artificial Sequence: Synthetic oligonucleotide"
aaugacacgguggccacga

SEQ ID NO: 538 - RNA, 19 nt, Artificial Sequence
  source: /note="Description of Artificial Sequence: Synthetic oligonucleotide"
gccacgaugaucuccugcu

SEQ ID NO: 539 - RNA, 19 nt, Artificial Sequence
  source: /note="Description of Artificial Sequence: Synthetic oligonucleotide"
uccugcuacuacgaagaca

SEQ ID NO: 540 - RNA, 19 nt, Artificial Sequence
  source: /note="Description of Artificial Sequence: Synthetic oligonucleotide"
agugcgaggucggcaugau

SEQ ID NO: 541 - RNA, 19 nt, Artificial Sequence
  source: /note="Description of Artificial Sequence: Synthetic oligonucleotide"
ggcaugaucgugggcacga

SEQ ID NO: 542 - RNA, 19 nt, Artificial Sequence
  source: /note="Description of Artificial Sequence: Synthetic oligonucleotide"
gugggcacgggcugcaaua

SEQ ID NO: 543 - RNA, 19 nt, Artificial Sequence
  source: /note="Description of Artificial Sequence: Synthetic oligonucleotide"
ugcaaugccugcuacauga

SEQ ID NO: 544 - RNA, 19 nt, Artificial Sequence
  source: /note="Description of Artificial Sequence: Synthetic oligonucleotide"
uacauggaggagaugcaga

SEQ ID NO: 545 - RNA, 19 nt, Artificial Sequence
  source: /note="Description of Artificial Sequence: Synthetic oligonucleotide"
agaugcagaauguggagcu

SEQ ID NO: 546 - RNA, 19 nt, Artificial Sequence
  source: /note="Description of Artificial Sequence: Synthetic oligonucleotide"
uguggagcugguggaggga

SEQ ID NO: 547 - RNA, 19 nt, Artificial Sequence
  source: /note="Description of Artificial Sequence: Synthetic oligonucleotide"
uggagggggacgagggcca

SEQ ID NO: 548 - RNA, 19 nt, Artificial Sequence
  source: /note="Description of Artificial Sequence: Synthetic oligonucleotide"
gagggccgcaugugcguca

SEQ ID NO: 549 - RNA, 19 nt, Artificial Sequence
  source: /note="Description of Artificial Sequence: Synthetic oligonucleotide"
ugcgucaauaccgagugga

SEQ ID NO: 550 - RNA, 19 nt, Artificial Sequence
  source: /note="Description of Artificial Sequence: Synthetic oligonucleotide"
cgaguggggcgccuucgga

SEQ ID NO: 551 - RNA, 19 nt, Artificial Sequence
  source: /note="Description of Artificial Sequence: Synthetic oligonucleotide"
gccuucggggacuccggca

SEQ ID NO: 552 - RNA, 19 nt, Artificial Sequence
  source: /note="Description of Artificial Sequence: Synthetic oligonucleotide"
uccggcgagcuggacgagu

SEQ ID NO: 553 - RNA, 19 nt, Artificial Sequence
  source: /note="Description of Artificial Sequence: Synthetic oligonucleotide"
gacgaguuccugcuggagu

SEQ ID NO: 554 - RNA, 19 nt, Artificial Sequence
  source: /note="Description of Artificial Sequence: Synthetic oligonucleotide"
ugcuggaguaugaccgccu

SEQ ID NO: 555 - RNA, 19 nt, Artificial Sequence
  source: /note="Description of Artificial Sequence: Synthetic oligonucleotide"
gaccgccugguggacgaga

SEQ ID NO: 556 - RNA, 19 nt, Artificial Sequence
  source: /note="Description of Artificial Sequence: Synthetic oligonucleotide"
ggacgagagcucugcaaac

SEQ ID NO: 557 - RNA, 19 nt, Artificial Sequence
  source: /note="Description of Artificial Sequence: Synthetic oligonucleotide"
ucugcaaaccccggucaga

SEQ ID NO: 558 - RNA, 19 nt, Artificial Sequence
  source: /note="Description of Artificial Sequence: Synthetic oligonucleotide"
ggucagcagcuguaugaga

SEQ ID NO: 559 - RNA, 19 nt, Artificial Sequence
  source: /note="Description of Artificial Sequence: Synthetic oligonucleotide"
uaugagaagcucauaggua

SEQ ID NO: 560 - RNA, 19 nt, Artificial Sequence
  source: /note="Description of Artificial Sequence: Synthetic oligonucleotide"
ucauagguggcaaguacau

SEQ ID NO: 561 - RNA, 19 nt, Artificial Sequence
  source: /note="Description of Artificial Sequence: Synthetic oligonucleotide"
aaguacaugggcgagcuga

SEQ ID NO: 562 - RNA, 19 nt, Artificial Sequence
  source: /note="Description of Artificial Sequence: Synthetic oligonucleotide"
gcgagcuggugcggcuugu

SEQ ID NO: 563 - RNA, 19 nt, Artificial Sequence
  source: /note="Description of Artificial Sequence: Synthetic oligonucleotide"
ggcuugugcugcucaggcu

SEQ ID NO: 564 - RNA, 19 nt, Artificial Sequence
  source: /note="Description of Artificial Sequence: Synthetic oligonucleotide"
ucaggcucguggacgaaaa

SEQ ID NO: 565 - RNA, 19 nt, Artificial Sequence
  source: /note="Description of Artificial Sequence: Synthetic oligonucleotide"
uggacgaaaaccugcucuu

SEQ ID NO: 566 - RNA, 19 nt, Artificial Sequence
  source: /note="Description of Artificial Sequence: Synthetic oligonucleotide"
ugcucuuccacggggagga

SEQ ID NO: 567 - RNA, 19 nt, Artificial Sequence
  source: /note="Description of Artificial Sequence: Synthetic oligonucleotide"
gggaggccuccgagcagcu

SEQ ID NO: 568 - RNA, 19 nt, Artificial Sequence
  source: /note="Description of Artificial Sequence: Synthetic oligonucleotide"
cgagcagcugcgcacacga

SEQ ID NO: 569 - RNA, 19 nt, Artificial Sequence
  source: /note="Description of Artificial Sequence: Synthetic oligonucleotide"
agccuucgagacgcgcuua

SEQ ID NO: 570 - RNA, 19 nt, Artificial Sequence
  source: /note="Description of Artificial Sequence: Synthetic oligonucleotide"
cgcuucgugucgcagguga

SEQ ID NO: 571 - RNA, 19 nt, Artificial Sequence
  source: /note="Description of Artificial Sequence: Synthetic oligonucleotide"
ucgcagguggagagcgaca

SEQ ID NO: 572 - RNA, 19 nt, Artificial Sequence
  source: /note="Description of Artificial Sequence: Synthetic oligonucleotide"
agcgacacgggcgaccgca

SEQ ID NO: 573 - RNA, 19 nt, Artificial Sequence
  source: /note="Description of Artificial Sequence: Synthetic oligonucleotide"
cgaccgcaagcagaucuaa

SEQ ID NO: 574 - RNA, 19 nt, Artificial Sequence
  source: /note="Description of Artificial Sequence: Synthetic oligonucleotide"
cagaucuacaacauccuga

SEQ ID NO: 575 - RNA, 19 nt, Artificial Sequence
  source: /note="Description of Artificial Sequence: Synthetic oligonucleotide"
uccugagcacgcuggggcu

SEQ ID NO: 576 - RNA, 19 nt, Artificial Sequence
  source: /note="Description of Artificial Sequence: Synthetic oligonucleotide"
cuggggcugcgacccucga

SEQ ID NO: 577 - RNA, 19 nt, Artificial Sequence
  source: /note="Description of Artificial Sequence: Synthetic oligonucleotide"
cgacccucgaccaccgacu

SEQ ID NO: 578 - RNA, 19 nt, Artificial Sequence
  source: /note="Description of Artificial Sequence: Synthetic oligonucleotide"
caccgacugcgacaucgua

SEQ ID NO: 579 - RNA, 19 nt, Artificial Sequence
  source: /note="Description of Artificial Sequence: Synthetic oligonucleotide"
caucgugcgccgcgccuga

SEQ ID NO: 580 - RNA, 19 nt, Artificial Sequence
  source: /note="Description of Artificial Sequence: Synthetic oligonucleotide"
cgcgccugcgagagcgugu

SEQ ID NO: 581 - RNA, 19 nt, Artificial Sequence
  source: /note="Description of Artificial Sequence: Synthetic oligonucleotide"
agcgugucuacgcgcgcua

SEQ ID NO: 582 - RNA, 19 nt, Artificial Sequence
  source: /note="Description of Artificial Sequence: Synthetic oligonucleotide"
cgcgcugcgcacaugugcu

SEQ ID NO: 583 - RNA, 19 nt, Artificial Sequence
  source: /note="Description of Artificial Sequence: Synthetic oligonucleotide"
acaugugcucggcggggcu

SEQ ID NO: 584 - RNA, 19 nt, Artificial Sequence
  source: /note="Description of Artificial Sequence: Synthetic oligonucleotide"
cggggcuggcgggcgucau

SEQ ID NO: 585 - RNA, 19 nt, Artificial Sequence
  source: /note="Description of Artificial Sequence: Synthetic oligonucleotide"
cgggcgucaucaaccgcau

SEQ ID NO: 586 - RNA, 19 nt, Artificial Sequence
  source: /note="Description of Artificial Sequence: Synthetic oligonucleotide"
aaccgcaugcgcgagagca

SEQ ID NO: 587 - RNA, 19 nt, Artificial Sequence
  source: /note="Description of Artificial Sequence: Synthetic oligonucleotide"
agagccgcagcgaggacgu

SEQ ID NO: 588 - RNA, 19 nt, Artificial Sequence
  source: /note="Description of Artificial Sequence: Synthetic oligonucleotide"
cgaggacguaaugcgcaua

SEQ ID NO: 589 - RNA, 19 nt, Artificial Sequence
  source: /note="Description of Artificial Sequence: Synthetic oligonucleotide"
ugcgcaucacugugggcgu

SEQ ID NO: 590 - RNA, 19 nt, Artificial Sequence
  source: /note="Description of Artificial Sequence: Synthetic oligonucleotide"
ugggcguggauggcuccgu

SEQ ID NO: 591 - RNA, 19 nt, Artificial Sequence
  source: /note="Description of Artificial Sequence: Synthetic oligonucleotide"
uggcuccguguacaagcua

SEQ ID NO: 592 - RNA, 19 nt, Artificial Sequence
  source: /note="Description of Artificial Sequence: Synthetic oligonucleotide"
uacaagcugcaccccagcu

SEQ ID NO: 593 - RNA, 19 nt, Artificial Sequence
  source: /note="Description of Artificial Sequence: Synthetic oligonucleotide"
ccagcuucaaggagcgguu

SEQ ID NO: 594 - RNA, 19 nt, Artificial Sequence
  source: /note="Description of Artificial Sequence: Synthetic oligonucleotide"
aggagcgguuccaugccaa

SEQ ID NO: 595 - RNA, 19 nt, Artificial Sequence
  source: /note="Description of Artificial Sequence: Synthetic oligonucleotide"
augccagcgugcgcaggcu

SEQ ID NO: 596 - RNA, 19 nt, Artificial Sequence
  source: /note="Description of Artificial Sequence: Synthetic oligonucleotide"
cgcaggcugacgcccagcu

SEQ ID NO: 597 - RNA, 19 nt, Artificial Sequence
  source: /note="Description of Artificial Sequence: Synthetic oligonucleotide"
cccagcugcgagaucaccu

SEQ ID NO: 598 - RNA, 19 nt, Artificial Sequence
  source: /note="Description of Artificial Sequence: Synthetic oligonucleotide"
gagaucaccuucaucgagu

SEQ ID NO: 599 - RNA, 19 nt, Artificial Sequence
  source: /note="Description of Artificial Sequence: Synthetic oligonucleotide"
aucgagucggaggagggca

SEQ ID NO: 600 - RNA, 19 nt, Artificial Sequence
  source: /note="Description of Artificial Sequence: Synthetic oligonucleotide"
aggagggcaguggccggga

SEQ ID NO: 601 - RNA, 19 nt, Artificial Sequence
  source: /note="Description of Artificial Sequence: Synthetic oligonucleotide"
ccggggcgcggcccuggua

SEQ ID NO: 602 - RNA, 19 nt, Artificial Sequence
  source: /note="Description of Artificial Sequence: Synthetic oligonucleotide"
cccuggucucggcggugga

SEQ ID NO: 603 - RNA, 19 nt, Artificial Sequence
  source: /note="Description of Artificial Sequence: Synthetic oligonucleotide"
gcgguggccuguaagaaga

SEQ ID NO: 604 - RNA, 19 nt, Artificial Sequence
  source: /note="Description of Artificial Sequence: Synthetic oligonucleotide"
uaagaaggccuguaugcua

SEQ ID NO: 605 - RNA, 19 nt, Artificial Sequence
  source: /note="Description of Artificial Sequence: Synthetic oligonucleotide"
cuguaugcugggccaguga

SEQ ID NO: 606 - RNA, 19 nt, Artificial Sequence
  source: /note="Description of Artificial Sequence: Synthetic oligonucleotide"
cagugagagcaguggccga

SEQ ID NO: 607 - RNA, 19 nt, Artificial Sequence
  source: /note="Description of Artificial Sequence: Synthetic oligonucleotide"
caguggccgcaagcgcaga

SEQ ID NO: 608 - RNA, 19 nt, Artificial Sequence
  source: /note="Description of Artificial Sequence: Synthetic oligonucleotide"
agcgcagggaggaugccaa

SEQ ID NO: 609 - RNA, 19 nt, Artificial Sequence
  source: /note="Description of Artificial Sequence: Synthetic oligonucleotide"
ugccacagccccacagcaa

SEQ ID NO: 610 - RNA, 19 nt, Artificial Sequence
  source: /note="Description of Artificial Sequence: Synthetic oligonucleotide"
cacagcacccaggcuccau

SEQ ID NO: 611 - RNA, 19 nt, Artificial Sequence
  source: /note="Description of Artificial Sequence: Synthetic oligonucleotide"
aggcuccauggggaaguga

SEQ ID NO: 612 - RNA, 19 nt, Artificial Sequence
  source: /note="Description of Artificial Sequence: Synthetic oligonucleotide"
ggaagugcuccccacacgu

SEQ ID NO: 613 - RNA, 19 nt, Artificial Sequence
  source: /note="Description of Artificial Sequence: Synthetic oligonucleotide"
ccacacgugcucgcagccu

SEQ ID NO: 614 - RNA, 19 nt, Artificial Sequence
  source: /note="Description of Artificial Sequence: Synthetic oligonucleotide"
ucgcagccuggcggggcaa

SEQ ID NO: 615 - RNA, 19 nt, Artificial Sequence
  source: /note="Description of Artificial Sequence: Synthetic oligonucleotide"
cggggcaggaggccuggca

SEQ ID NO: 616 - RNA, 19 nt, Artificial Sequence
  source: /note="Description of Artificial Sequence: Synthetic oligonucleotide"
ccuggccuugucaggacca

SEQ ID NO: 617 - RNA, 19 nt, Artificial Sequence
  source: /note="Description of Artificial Sequence: Synthetic oligonucleotide"
caggacccaggccgccuga

SEQ ID NO: 618 - RNA, 19 nt, Artificial Sequence
  source: /note="Description of Artificial Sequence: Synthetic oligonucleotide"
ccgccugccauaccgcuga

SEQ ID NO: 619 - RNA, 19 nt, Artificial Sequence
  source: /note="Description of Artificial Sequence: Synthetic oligonucleotide"
uaccgcuggggaacagaga

SEQ ID NO: 620 - RNA, 19 nt, Artificial Sequence
  source: /note="Description of Artificial Sequence: Synthetic oligonucleotide"
aacagagcgggccucuuca

SEQ ID NO: 621 - RNA, 19 nt, Artificial Sequence
  source: /note="Description of Artificial Sequence: Synthetic oligonucleotide"
cucuucccucaguuuuuca

SEQ ID NO: 622 - RNA, 19 nt, Artificial Sequence
  source: /note="Description of Artificial Sequence: Synthetic oligonucleotide"
uuuuucggugggacagcca

SEQ ID NO: 623 - RNA, 19 nt, Artificial Sequence
  source: /note="Description of Artificial Sequence: Synthetic oligonucleotide"
gggacagccccagggcccu

SEQ ID NO: 624 - RNA, 19 nt, Artificial Sequence
  source: /note="Description of Artificial Sequence: Synthetic oligonucleotide"
agggcccuaacggggguga

SEQ ID NO: 625 - RNA, 19 nt, Artificial Sequence
  source: /note="Description of Artificial Sequence: Synthetic oligonucleotide"
gggugcggcaggagcagga

SEQ ID NO: 626 - RNA, 19 nt, Artificial Sequence
  source: /note="Description of Artificial Sequence: Synthetic oligonucleotide"
aggagcaggaacagagacu

SEQ ID NO: 627 - RNA, 19 nt, Artificial Sequence
  source: /note="Description of Artificial Sequence: Synthetic oligonucleotide"
agagacucuggaagcccca

SEQ ID NO: 628 - RNA, 19 nt, Artificial Sequence
  source: /note="Description of Artificial Sequence: Synthetic oligonucleotide"
aagccccccaccuuucuca

SEQ ID NO: 629 - RNA, 19 nt, Artificial Sequence
  source: /note="Description of Artificial Sequence: Synthetic oligonucleotide"
uuucucgcuggaaucaauu

SEQ ID NO: 630 - RNA, 19 nt, Artificial Sequence
  source: /note="Description of Artificial Sequence: Synthetic oligonucleotide"
aaucaauuucccagaagga

SEQ ID NO: 631 - RNA, 19 nt, Artificial Sequence
  source: /note="Description of Artificial Sequence: Synthetic oligonucleotide"
cccagaagggaguugcuca

SEQ ID NO: 632 - RNA, 19 nt, Artificial Sequence
  source: /note="Description of Artificial Sequence: Synthetic oligonucleotide"
uugcucacucaggacuuua

SEQ ID NO: 633 - RNA, 19 nt, Artificial Sequence
  source: /note="Description of Artificial Sequence: Synthetic oligonucleotide"
aggacuuugaugcauuuca

SEQ ID NO: 634 - RNA, 19 nt, Artificial Sequence
  source: /note="Description of Artificial Sequence: Synthetic oligonucleotide"
auuuccacacugucagaga

SEQ ID NO: 635 - RNA, 19 nt, Artificial Sequence
  source: /note="Description of Artificial Sequence: Synthetic oligonucleotide"
ugucagagcuguuggccua

SEQ ID NO: 636 - RNA, 19 nt, Artificial Sequence
  source: /note="Description of Artificial Sequence: Synthetic oligonucleotide"
uuggccucgccugggccca

SEQ ID NO: 637 - RNA, 19 nt, Artificial Sequence
  source: /note="Description of Artificial Sequence: Synthetic oligonucleotide"
cugggcccaggcucuggga

SEQ ID NO: 638 - RNA, 19 nt, Artificial Sequence
  source: /note="Description of Artificial Sequence: Synthetic oligonucleotide"
cucugggaaggggugcccu

SEQ ID NO: 639 - RNA, 19 nt, Artificial Sequence
  source: /note="Description of Artificial Sequence: Synthetic oligonucleotide"
ugcccucuggauccugcua

SEQ ID NO: 640 - RNA, 19 nt, Artificial Sequence
  source: /note="Description of Artificial Sequence: Synthetic oligonucleotide"
uccugcuguggccucacuu

SEQ ID NO: 641 - RNA, 19 nt, Artificial Sequence
  source: /note="Description of Artificial Sequence: Synthetic oligonucleotide"
ccucacuucccugggaacu

SEQ ID NO: 642 - RNA, 19 nt, Artificial Sequence
  source: /note="Description of Artificial Sequence: Synthetic oligonucleotide"
cugggaacucauccugugu

SEQ ID NO: 643 - RNA, 19 nt, Artificial Sequence
  source: /note="Description of Artificial Sequence: Synthetic oligonucleotide"
ccuguguggggaggcagcu

SEQ ID NO: 644 - RNA, 19 nt, Artificial Sequence
  source: /note="Description of Artificial Sequence: Synthetic oligonucleotide"
ggaggcagcuccaacagcu

SEQ ID NO: 645 - RNA, 19 nt, Artificial Sequence
  source: /note="Description of Artificial Sequence: Synthetic oligonucleotide"
caacagcuugaccagaccu

SEQ ID NO: 646 - RNA, 19 nt, Artificial Sequence
  source: /note="Description of Artificial Sequence: Synthetic oligonucleotide"
ccagaccuagaccugggca

SEQ ID NO: 647 - RNA, 19 nt, Artificial Sequence
  source: /note="Description of Artificial Sequence: Synthetic oligonucleotide"
cugggccaaaagggcagca

SEQ ID NO: 648 - RNA, 19 nt, Artificial Sequence
  source: /note="Description of Artificial Sequence: Synthetic oligonucleotide"
agggcagccaggggcugcu

SEQ ID NO: 649 - RNA, 19 nt, Artificial Sequence
  source: /note="Description of Artificial Sequence: Synthetic oligonucleotide"
gggcugcucaucacccagu

SEQ ID NO: 650 - RNA, 19 nt, Artificial Sequence
  source: /note="Description of Artificial Sequence: Synthetic oligonucleotide"
acccaguccuggccauuuu

SEQ ID NO: 651 - RNA, 19 nt, Artificial Sequence
  source: /note="Description of Artificial Sequence: Synthetic oligonucleotide"
gccauuuucuugccugaga

SEQ ID NO: 652 - RNA, 19 nt, Artificial Sequence
  source: /note="Description of Artificial Sequence: Synthetic oligonucleotide"
ccugaggcucaagaggcca

SEQ ID NO: 653 - RNA, 19 nt, Artificial Sequence
  source: /note="Description of Artificial Sequence: Synthetic oligonucleotide"
aagaggcccagggagcaau

SEQ ID NO: 654 - RNA, 19 nt, Artificial Sequence
  source: /note="Description of Artificial Sequence: Synthetic oligonucleotide"
ggagcaaugggagggggcu

SEQ ID NO: 655 - RNA, 19 nt, Artificial Sequence
  source: /note="Description of Artificial Sequence: Synthetic oligonucleotide"
agggggcuccauggaggaa

SEQ ID NO: 656 - RNA, 19 nt, Artificial Sequence
  source: /note="Description of Artificial Sequence: Synthetic oligonucleotide"
ggaggaggugucccaagcu

SEQ ID NO: 657 - RNA, 19 nt, Artificial Sequence
  source: /note="Description of Artificial Sequence: Synthetic oligonucleotide"
ucccaagcuuugaauacca

SEQ ID NO: 658 - RNA, 19 nt, Artificial Sequence
  source: /note="Description of Artificial Sequence: Synthetic oligonucleotide"
aauacccccagagaccuuu

SEQ ID NO: 659 - RNA, 19 nt, Artificial Sequence
  source: /note="Description of Artificial Sequence: Synthetic oligonucleotide"
agagaccuuuucucuccca

SEQ ID NO: 660 - RNA, 19 nt, Artificial Sequence
  source: /note="Description of Artificial Sequence: Synthetic oligonucleotide"
ucucccauaccaucacuga

SEQ ID NO: 661 - RNA, 19 nt, Artificial Sequence
  source: /note="Description of Artificial Sequence: Synthetic oligonucleotide"
ucacugaguggcuugugau

SEQ ID NO: 662 - RNA, 19 nt, Artificial Sequence
  source: /note="Description of Artificial Sequence: Synthetic oligonucleotide"
ggcuugugauucugggaua

SEQ ID NO: 663 - RNA, 19 nt, Artificial Sequence
  source: /note="Description of Artificial Sequence: Synthetic oligonucleotide"
ugggauggacccucgcaga

SEQ ID NO: 664 - RNA, 19 nt, Artificial Sequence
  source: /note="Description of Artificial Sequence: Synthetic oligonucleotide"
ucgcagcaggugcaagaga

SEQ ID NO: 665 - RNA, 19 nt, Artificial Sequence
  source: /note="Description of Artificial Sequence: Synthetic oligonucleotide"
ugcaagagacagagcccca

SEQ ID NO: 666 - RNA, 19 nt, Artificial Sequence
  source: /note="Description of Artificial Sequence: Synthetic oligonucleotide"
agagcccccaagccucuga

SEQ ID NO: 667 - RNA, 19 nt, Artificial Sequence
  source: /note="Description of Artificial Sequence: Synthetic oligonucleotide"
cucugccccaaggggccca

SEQ ID NO: 668 - RNA, 19 nt, Artificial Sequence
  source: /note="Description of Artificial Sequence: Synthetic oligonucleotide"
aaggggcccacaaagggga

SEQ ID NO: 669 - RNA, 19 nt, Artificial Sequence
  source: /note="Description of Artificial Sequence: Synthetic oligonucleotide"
aaaggggagaagggccaga

SEQ ID NO: 670 - RNA, 19 nt, Artificial Sequence
  source: /note="Description of Artificial Sequence: Synthetic oligonucleotide"
gggccagcccuacaucuua

SEQ ID NO: 671 - RNA, 19 nt, Artificial Sequence
  source: /note="Description of Artificial Sequence: Synthetic oligonucleotide"
aucuucagcucccauagca

SEQ ID NO: 672 - RNA, 19 nt, Artificial Sequence
  source: /note="Description of Artificial Sequence: Synthetic oligonucleotide"
ucccauagcgcuggcucaa

SEQ ID NO: 673 - RNA, 19 nt, Artificial Sequence
  source: /note="Description of Artificial Sequence: Synthetic oligonucleotide"
uggcucaggaagaaaccca

SEQ ID NO: 674 - RNA, 19 nt, Artificial Sequence
  source: /note="Description of Artificial Sequence: Synthetic oligonucleotide"
aaccccaagcagcauucaa

SEQ ID NO: 675 - RNA, 19 nt, Artificial Sequence
  source: /note="Description of Artificial Sequence: Synthetic oligonucleotide"
cagcauucagcacacccca

SEQ ID NO: 676 - RNA, 19 nt, Artificial Sequence
  source: /note="Description of Artificial Sequence: Synthetic oligonucleotide"
caccccaagggacaaccca

SEQ ID NO: 677 - RNA, 19 nt, Artificial Sequence
  source: /note="Description of Artificial Sequence: Synthetic oligonucleotide"
acaaccccaucauaugaca

SEQ ID NO: 678 - RNA, 19 nt, Artificial Sequence
  source: /note="Description of Artificial Sequence: Synthetic oligonucleotide"
acccucuccaugcccaaca

SEQ ID NO: 679 - RNA, 19 nt, Artificial Sequence
  source: /note="Description of Artificial Sequence: Synthetic oligonucleotide"
ugcccaaccuaagauugua

SEQ ID NO: 680 - RNA, 19 nt, Artificial Sequence
  source: /note="Description of Artificial Sequence: Synthetic oligonucleotide"
aagauuguguggguuuuuu

SEQ ID NO: 681 - RNA, 19 nt, Artificial Sequence
  source: /note="Description of Artificial Sequence: Synthetic oligonucleotide"
uuuuuuaauuaaaaauguu

SEQ ID NO: 682 - RNA, 19 nt, Artificial Sequence
  source: /note="Description of Artificial Sequence: Synthetic oligonucleotide"
uaaaaauguuaaaaguuuu

SEQ ID NO: 683 - RNA, 19 nt, Artificial Sequence
  source: /note="Description of Artificial Sequence: Synthetic oligonucleotide"
aaaguuuuaaacaugaaaa

SEQ ID NO: 684 - RNA, 19 nt, Artificial Sequence
  source: /note="Description of Artificial Sequence: Synthetic oligonucleotide"
agcugccugaggcuggcag

SEQ ID NO: 685 - RNA, 19 nt, Artificial Sequence
  source: /note="Description of Artificial Sequence: Synthetic oligonucleotide"
uggauggagagcugccuga

SEQ ID NO: 686 - RNA, 19 nt, Artificial Sequence
  source: /note="Description of Artificial Sequence: Synthetic oligonucleotide"
ucaacggcugcuuggaugg

SEQ ID NO: 687 - RNA, 19 nt, Artificial Sequence
  source: /note="Description of Artificial Sequence: Synthetic oligonucleotide"
uccuguggcagcaacggcu

SEQ ID NO: 688 - RNA, 19 nt, Artificial Sequence
  source: /note="Description of Artificial Sequence: Synthetic oligonucleotide"
uagcguaaggcccgccugu

SEQ ID NO: 689 - RNA, 19 nt, Artificial Sequence
  source: /note="Description of Artificial Sequence: Synthetic oligonucleotide"
uuguagccuuggagcguaa

SEQ ID NO: 690 - RNA, 19 nt, Artificial Sequence
  source: /note="Description of Artificial Sequence: Synthetic oligonucleotide"
uagcacaugcuguagccuu

SEQ ID NO: 691 - RNA, 19 nt, Artificial Sequence
  source: /note="Description of Artificial Sequence: Synthetic oligonucleotide"
ucugcugaggccuagcaca

SEQ ID NO: 692 - RNA, 19 nt, Artificial Sequence
  source: /note="Description of Artificial Sequence: Synthetic oligonucleotide"
agaugcuccugccugcuga

SEQ ID NO: 693 - RNA, 19 nt, Artificial Sequence
  source: /note="Description of Artificial Sequence: Synthetic oligonucleotide"
uuugggaggcagagaugcu

SEQ ID NO: 694 - RNA, 19 nt, Artificial Sequence
  source: /note="Description of Artificial Sequence: Synthetic oligonucleotide"
agguagaugcuuugggagg

SEQ ID NO: 695 - RNA, 19 nt, Artificial Sequence
  source: /note="Description of Artificial Sequence: Synthetic oligonucleotide"
ucaucucuccgaggggcua

SEQ ID NO: 696 - RNA, 19 nt, Artificial Sequence
  source: /note="Description of Artificial Sequence: Synthetic oligonucleotide"
uacauccaucgccaucucu

SEQ ID NO: 697 - RNA, 19 nt, Artificial Sequence
  source: /note="Description of Artificial Sequence: Synthetic oligonucleotide"
uggcuccuugugacaucca

SEQ ID NO: 698 - RNA, 19 nt, Artificial Sequence
  source: /note="Description of Artificial Sequence: Synthetic oligonucleotide"
uugucugggccuggcuccu

SEQ ID NO: 699 - RNA, 19 nt, Artificial Sequence
  source: /note="Description of Artificial Sequence: Synthetic oligonucleotide"
ugaucugcucuaccagagu

SEQ ID NO: 700 - RNA, 19 nt, Artificial Sequence
  source: /note="Description of Artificial Sequence: Synthetic oligonucleotide"
aacucugccaggaucugcu

SEQ ID NO: 701 - RNA, 19 nt, Artificial Sequence
  source: /note="Description of Artificial Sequence: Synthetic oligonucleotide"
uccugcagcuggaacucug

SEQ ID NO: 702 - RNA, 19 nt, Artificial Sequence
  source: /note="Description of Artificial Sequence: Synthetic oligonucleotide"
agguccuccuccugcagcu

SEQ ID NO: 703 - RNA, 19 nt, Artificial Sequence
  source: /note="Description of Artificial Sequence: Synthetic oligonucleotide"
aucaccuucuucagguccu

SEQ ID NO: 704 - RNA, 19 nt, Artificial Sequence
  source: /note="Description of Artificial Sequence: Synthetic oligonucleotide"
ucauccgucucaucaccuu

SEQ ID NO: 705 - RNA, 19 nt, Artificial Sequence
  source: /note="Description of Artificial Sequence: Synthetic oligonucleotide"
ucaucuccuucugcauccg

SEQ ID NO: 706 - RNA, 19 nt, Artificial Sequence
  source: /note="Description of Artificial Sequence: Synthetic oligonucleotide"
ugccgcgguccaucuccuu

SEQ ID NO: 707 - RNA, 19 nt, Artificial Sequence
  source: /note="Description of Artificial Sequence: Synthetic oligonucleotide"
ucuccagccucaggccgcg

SEQ ID NO: 708 - RNA, 19 nt, Artificial Sequence
  source: /note="Description of Artificial Sequence: Synthetic oligonucleotide"
ucucuucaugggucuccag

SEQ ID NO: 709 - RNA, 19 nt, Artificial Sequence
  source: /note="Description of Artificial Sequence: Synthetic oligonucleotide"
ucacacuggccucuucaug

SEQ ID NO: 710 - RNA, 19 nt, Artificial Sequence
  source: /note="Description of Artificial Sequence: Synthetic oligonucleotide"
uggcagcaucuucacacug

SEQ ID NO: 711 - RNA, 19 nt, Artificial Sequence
  source: /note="Description of Artificial Sequence: Synthetic oligonucleotide"
ugcacguaggugggcagca

SEQ ID NO: 712 - RNA, 19 nt, Artificial Sequence
  source: /note="Description of Artificial Sequence: Synthetic oligonucleotide"
uugggguggagcgcacgua

SEQ ID NO: 713 - RNA, 19 nt, Artificial Sequence
  source: /note="Description of Artificial Sequence: Synthetic oligonucleotide"
uuucugagccuucuggggu

SEQ ID NO: 714 - RNA, 19 nt, Artificial Sequence
  source: /note="Description of Artificial Sequence: Synthetic oligonucleotide"
ugaaguccccgacuucuga

SEQ ID NO: 715 - RNA, 19 nt, Artificial Sequence
  source: /note="Description of Artificial Sequence: Synthetic oligonucleotide"
ucagggagaggaagucccc

SEQ ID NO: 716 - RNA, 19 nt, Artificial Sequence
  source: /note="Description of Artificial Sequence: Synthetic oligonucleotide"
ugccacccagguccaggga

SEQ ID NO: 717 - RNA, 19 nt, Artificial Sequence
  source: /note="Description of Artificial Sequence: Synthetic oligonucleotide"
uugaaguuagugccaccca

SEQ ID NO: 718 - RNA, 19 nt, Artificial Sequence
  source: /note="Description of Artificial Sequence: Synthetic oligonucleotide"
accagcaucacccugaagu

SEQ ID NO: 719 - RNA, 19 nt, Artificial Sequence
  source: /note="Description of Artificial Sequence: Synthetic oligonucleotide"
uccucaccuucucccaccu

SEQ ID NO: 720 - RNA, 19 nt, Artificial Sequence
  source: /note="Description of Artificial Sequence: Synthetic oligonucleotide"
uggucuucacgcuccacug

SEQ ID NO: 721 - RNA, 19 nt, Artificial Sequence
  source: /note="Description of Artificial Sequence: Synthetic oligonucleotide"
ugggauggaguacaucugg

SEQ ID NO: 722 - RNA, 19 nt, Artificial Sequence
  source: /note="Description of Artificial Sequence: Synthetic oligonucleotide"
ucaucucagcagugccggu

SEQ ID NO: 723 - RNA, 19 nt, Artificial Sequence
  source: /note="Description of Artificial Sequence: Synthetic oligonucleotide"
auguagucgaagagcaucu

SEQ ID NO: 724 - RNA, 19 nt, Artificial Sequence
  source: /note="Description of Artificial Sequence: Synthetic oligonucleotide"
uacucagagauguagucga

SEQ ID NO: 725 - RNA, 19 nt, Artificial Sequence
  source: /note="Description of Artificial Sequence: Synthetic oligonucleotide"
agucggagaugcacucaga

SEQ ID NO: 726 - RNA, 19 nt, Artificial Sequence
  source: /note="Description of Artificial Sequence: Synthetic oligonucleotide"
ucuuguccaggaagucgga

SEQ ID NO: 727 - RNA, 19 nt, Artificial Sequence
  source: /note="Description of Artificial Sequence: Synthetic oligonucleotide"
guuucaucugaugcuuguc

SEQ ID NO: 728 - RNA, 19 nt, Artificial Sequence
  source: /note="Description of Artificial Sequence: Synthetic oligonucleotide"
agcuucuuguguuucaucu

SEQ ID NO: 729 - RNA, 19 nt, Artificial Sequence
  source: /note="Description of Artificial Sequence: Synthetic oligonucleotide"
aagcccaggggcagcuucu

SEQ ID NO: 730 - RNA, 19 nt, Artificial Sequence
  source: /note="Description of Artificial Sequence: Synthetic oligonucleotide"
ugagaaggugaagcccagg

SEQ ID NO: 731 - RNA, 19 nt, Artificial Sequence
  source: /note="Description of Artificial Sequence: Synthetic oligonucleotide"
ucacaggaaaggagaaggu

SEQ ID NO: 732 - RNA, 19 nt, Artificial Sequence
  source: /note="Description of Artificial Sequence: Synthetic oligonucleotide"
augucuucgugccucacag

SEQ ID NO: 733 - RNA, 19 nt, Artificial Sequence
  source: /note="Description of Artificial Sequence: Synthetic oligonucleotide"
ugcccuuaucgaugucuuc

SEQ ID NO: 734 - RNA, 19 nt, Artificial Sequence
  source: /note="Description of Artificial Sequence: Synthetic oligonucleotide"
ugagaaggaugcccuuauc

SEQ ID NO: 735 - RNA, 19 nt, Artificial Sequence
  source: /note="Description of Artificial Sequence: Synthetic oligonucleotide"
uccuugguccaguugagaa

SEQ ID NO: 736 - RNA, 19 nt, Artificial Sequence
  source: /note="Description of Artificial Sequence: Synthetic oligonucleotide"
aggccuugaagcccuuggu

SEQ ID NO: 737 - RNA, 19 nt, Artificial Sequence
  source: /note="Description of Artificial Sequence: Synthetic oligonucleotide"
uucugcuccugaggccuug

SEQ ID NO: 738 - RNA, 19 nt, Artificial Sequence
  source: /note="Description of Artificial Sequence: Synthetic oligonucleotide"
auuguucccuucugcuccu

SEQ ID NO: 739 - RNA, 19 nt, Artificial Sequence
  source: /note="Description of Artificial Sequence: Synthetic oligonucleotide"
uaagccccacgacauuguu

SEQ ID NO: 740 - RNA, 19 nt, Artificial Sequence
  source: /note="Description of Artificial Sequence: Synthetic oligonucleotide"
ucgucucgcagaagcccca

SEQ ID NO: 741 - RNA, 19 nt, Artificial Sequence
  source: /note="Description of Artificial Sequence: Synthetic oligonucleotide"
uccguuugauagcgucucg

SEQ ID NO: 742 - RNA, 19 nt, Artificial Sequence
  source: /note="Description of Artificial Sequence: Synthetic oligonucleotide"
uaaaguccccucuccguuu

SEQ ID NO: 743 - RNA, 19 nt, Artificial Sequence
  source: /note="Description of Artificial Sequence: Synthetic oligonucleotide"
acauccauuucaaaguccc

SEQ ID NO: 744 - RNA, 19 nt, Artificial Sequence
  source: /note="Description of Artificial Sequence: Synthetic oligonucleotide"
ucgugucauucaccauugc

SEQ ID NO: 745 - RNA, 19 nt, Artificial Sequence
  source: /note="Description of Artificial Sequence: Synthetic oligonucleotide"
ucguggccaccgugucauu

SEQ ID NO: 746 - RNA, 19 nt, Artificial Sequence
  source: /note="Description of Artificial Sequence: Synthetic oligonucleotide"
agcaggagaucaucguggc

SEQ ID NO: 747 - RNA, 19 nt, Artificial Sequence
  source: /note="Description of Artificial Sequence: Synthetic oligonucleotide"
ugucuucguaguagcagga

SEQ ID NO: 748 - RNA, 19 nt, Artificial Sequence
  source: /note="Description of Artificial Sequence: Synthetic oligonucleotide"
aucaugccgaccucgcacu

SEQ ID NO: 749 - RNA, 19 nt, Artificial Sequence
  source: /note="Description of Artificial Sequence: Synthetic oligonucleotide"
ucgugcccacgaucaugcc

SEQ ID NO: 750 - RNA, 19 nt, Artificial Sequence
  source: /note="Description of Artificial Sequence: Synthetic oligonucleotide"
uauugcagcccgugcccac

SEQ ID NO: 751 - RNA, 19 nt, Artificial Sequence
  source: /note="Description of Artificial Sequence: Synthetic oligonucleotide"
ucauguagcaggcauugca

SEQ ID NO: 752 - RNA, 19 nt, Artificial Sequence
  source: /note="Description of Artificial Sequence: Synthetic oligonucleotide"
ucugcaucuccuccaugua

SEQ ID NO: 753 - RNA, 19 nt, Artificial Sequence
  source: /note="Description of Artificial Sequence: Synthetic oligonucleotide"
agcuccacauucugcaucu

SEQ ID NO: 754 - RNA, 19 nt, Artificial Sequence
  source: /note="Description of Artificial Sequence: Synthetic oligonucleotide"
ucccuccaccagcuccaca

SEQ ID NO: 755 - RNA, 19 nt, Artificial Sequence
  source: /note="Description of Artificial Sequence: Synthetic oligonucleotide"
uggcccucgucccccucca

SEQ ID NO: 756 - RNA, 19 nt, Artificial Sequence
  source: /note="Description of Artificial Sequence: Synthetic oligonucleotide"
ugacgcacaugcggcccuc

SEQ ID NO: 757 - RNA, 19 nt, Artificial Sequence
  source: /note="Description of Artificial Sequence: Synthetic oligonucleotide"
uccacucgguauugacgca

SEQ ID NO: 758 - RNA, 19 nt, Artificial Sequence
  source: /note="Description of Artificial Sequence: Synthetic oligonucleotide"
uccgaaggcgccccacucg

SEQ ID NO: 759 - RNA, 19 nt, Artificial Sequence
  source: /note="Description of Artificial Sequence: Synthetic oligonucleotide"
ugccggaguccccgaaggc

SEQ ID NO: 760 - RNA, 19 nt, Artificial Sequence
  source: /note="Description of Artificial Sequence: Synthetic oligonucleotide"
acucguccagcucgccgga

SEQ ID NO: 761 - RNA, 19 nt, Artificial Sequence
  source: /note="Description of Artificial Sequence: Synthetic oligonucleotide"
acuccagcaggaacucguc

SEQ ID NO: 762 - RNA, 19 nt, Artificial Sequence
  source: /note="Description of Artificial Sequence: Synthetic oligonucleotide"
aggcggucauacuccagca

SEQ ID NO: 763 - RNA, 19 nt, Artificial Sequence
  source: /note="Description of Artificial Sequence: Synthetic oligonucleotide"
ucucguccaccaggcgguc

SEQ ID NO: 764 - RNA, 19 nt, Artificial Sequence
  source: /note="Description of Artificial Sequence: Synthetic oligonucleotide"
guuugcagagcucucgucc

SEQ ID NO: 765 - RNA, 19 nt, Artificial Sequence
  source: /note="Description of Artificial Sequence: Synthetic oligonucleotide"
ucugaccgggguuugcaga

SEQ ID NO: 766 - RNA, 19 nt, Artificial Sequence
  source: /note="Description of Artificial Sequence: Synthetic oligonucleotide"
ucucauacagcugcugacc

SEQ ID NO: 767 - RNA, 19 nt, Artificial Sequence
  source: /note="Description of Artificial Sequence: Synthetic oligonucleotide"
uaccuaugagcuucucaua

SEQ ID NO: 768 - RNA, 19 nt, Artificial Sequence
  source: /note="Description of Artificial Sequence: Synthetic oligonucleotide"
auguacuugccaccuauga

SEQ ID NO: 769 - RNA, 19 nt, Artificial Sequence
  source: /note="Description of Artificial Sequence: Synthetic oligonucleotide"
ucagcucgcccauguacuu

SEQ ID NO: 770 - RNA, 19 nt, Artificial Sequence
  source: /note="Description of Artificial Sequence: Synthetic oligonucleotide"
acaagccgcaccagcucgc

SEQ ID NO: 771 - RNA, 19 nt, Artificial Sequence
  source: /note="Description of Artificial Sequence: Synthetic oligonucleotide"
agccugagcagcacaagcc

SEQ ID NO: 772 - RNA, 19 nt, Artificial Sequence
  source: /note="Description of Artificial Sequence: Synthetic oligonucleotide"
uuuucguccacgagccuga

SEQ ID NO: 773 - RNA, 19 nt, Artificial Sequence
  source: /note="Description of Artificial Sequence: Synthetic oligonucleotide"
aagagcagguuuucgucca

SEQ ID NO: 774 - RNA, 19 nt, Artificial Sequence
  source: /note="Description of Artificial Sequence: Synthetic oligonucleotide"
uccuccccguggaagagca

SEQ ID NO: 775 - RNA, 19 nt, Artificial Sequence
  source: /note="Description of Artificial Sequence: Synthetic oligonucleotide"
agcugcucggaggccuccc

SEQ ID NO: 776 - RNA, 19 nt, Artificial Sequence
  source: /note="Description of Artificial Sequence: Synthetic oligonucleotide"
ucgugugcgcagcugcucg

SEQ ID NO: 777 - RNA, 19 nt, Artificial Sequence
  source: /note="Description of Artificial Sequence: Synthetic oligonucleotide"
uaagcgcgucucgaaggcu

SEQ ID NO: 778 - RNA, 19 nt, Artificial Sequence
  source: /note="Description of Artificial Sequence: Synthetic oligonucleotide"
ucaccugcgacacgaagcg

SEQ ID NO: 779 - RNA, 19 nt, Artificial Sequence
  source: /note="Description of Artificial Sequence: Synthetic oligonucleotide"
ugucgcucuccaccugcga

SEQ ID NO: 780 - RNA, 19 nt, Artificial Sequence
  source: /note="Description of Artificial Sequence: Synthetic oligonucleotide"
ugcggucgcccgugucgcu

SEQ ID NO: 781 - RNA, 19 nt, Artificial Sequence
  source: /note="Description of Artificial Sequence: Synthetic oligonucleotide"
uuagaucugcuugcggucg

SEQ ID NO: 782 - RNA, 19 nt, Artificial Sequence
  source: /note="Description of Artificial Sequence: Synthetic oligonucleotide"
ucaggauguuguagaucug

SEQ ID NO: 783 - RNA, 19 nt, Artificial Sequence
  source: /note="Description of Artificial Sequence: Synthetic oligonucleotide"
agccccagcgugcucagga

SEQ ID NO: 784 - RNA, 19 nt, Artificial Sequence
  source: /note="Description of Artificial Sequence: Synthetic oligonucleotide"
ucgagggucgcagccccag

SEQ ID NO: 785 - RNA, 19 nt, Artificial Sequence
  source: /note="Description of Artificial Sequence: Synthetic oligonucleotide"
agucgguggucgagggucg

SEQ ID NO: 786 - RNA, 19 nt, Artificial Sequence
  source: /note="Description of Artificial Sequence: Synthetic oligonucleotide"
uacgaugucgcagucggug

SEQ ID NO: 787 - RNA, 19 nt, Artificial Sequence
  source: /note="Description of Artificial Sequence: Synthetic oligonucleotide"
ucaggcgcggcgcacgaug

SEQ ID NO: 788 - RNA, 19 nt, Artificial Sequence
  source: /note="Description of Artificial Sequence: Synthetic oligonucleotide"
acacgcucucgcaggcgcg

SEQ ID NO: 789 - RNA, 19 nt, Artificial Sequence
  source: /note="Description of Artificial Sequence: Synthetic oligonucleotide"
uagcgcgcguagacacgcu

SEQ ID NO: 790 - RNA, 19 nt, Artificial Sequence
  source: /note="Description of Artificial Sequence: Synthetic oligonucleotide"
agcacaugugcgcagcgcg

SEQ ID NO: 791 - RNA, 19 nt, Artificial Sequence
  source: /note="Description of Artificial Sequence: Synthetic oligonucleotide"
agccccgccgagcacaugu

SEQ ID NO: 792 - RNA, 19 nt, Artificial Sequence
  source: /note="Description of Artificial Sequence: Synthetic oligonucleotide"
augacgcccgccagccccg

SEQ ID NO: 793 - RNA, 19 nt, Artificial Sequence
  source: /note="Description of Artificial Sequence: Synthetic oligonucleotide"
augcgguugaugacgcccg

SEQ ID NO: 794 - RNA, 19 nt, Artificial Sequence
  source: /note="Description of Artificial Sequence: Synthetic oligonucleotide"
ugcucucgcgcaugcgguu

SEQ ID NO: 795 - RNA, 19 nt, Artificial Sequence
  source: /note="Description of Artificial Sequence: Synthetic oligonucleotide"
acguccucgcugcggcucu

SEQ ID NO: 796 - RNA, 19 nt, Artificial Sequence
  source: /note="Description of Artificial Sequence: Synthetic oligonucleotide"
uaugcgcauuacguccucg

SEQ ID NO: 797 - RNA, 19 nt, Artificial Sequence
  source: /note="Description of Artificial Sequence: Synthetic oligonucleotide"
acgcccacagugaugcgca

SEQ ID NO: 798 - RNA, 19 nt, Artificial Sequence
  source: /note="Description of Artificial Sequence: Synthetic oligonucleotide"
acggagccauccacgccca

SEQ ID NO: 799 - RNA, 19 nt, Artificial Sequence
  source: /note="Description of Artificial Sequence: Synthetic oligonucleotide"
uagcuuguacacggagcca

SEQ ID NO: 800 - RNA, 19 nt, Artificial Sequence
  source: /note="Description of Artificial Sequence: Synthetic oligonucleotide"
agcuggggugcagcuugua

SEQ ID NO: 801 - RNA, 19 nt, Artificial Sequence
  source: /note="Description of Artificial Sequence: Synthetic oligonucleotide"
aaccgcuccuugaagcugg

SEQ ID NO: 802 - RNA, 19 nt, Artificial Sequence
  source: /note="Description of Artificial Sequence: Synthetic oligonucleotide"
uuggcauggaaccgcuccu

SEQ ID NO: 803 - RNA, 19 nt, Artificial Sequence
  source: /note="Description of Artificial Sequence: Synthetic oligonucleotide"
agccugcgcacgcuggcau

SEQ ID NO: 804 - RNA, 19 nt, Artificial Sequence
  source: /note="Description of Artificial Sequence: Synthetic oligonucleotide"
agcugggcgucagccugcg

SEQ ID NO: 805 - RNA, 19 nt, Artificial Sequence
  source: /note="Description of Artificial Sequence: Synthetic oligonucleotide"
aggugaucucgcagcuggg

SEQ ID NO: 806 - RNA, 19 nt, Artificial Sequence
  source: /note="Description of Artificial Sequence: Synthetic oligonucleotide"
acucgaugaaggugaucuc

SEQ ID NO: 807 - RNA, 19 nt, Artificial Sequence
  source: /note="Description of Artificial Sequence: Synthetic oligonucleotide"
ugcccuccuccgacucgau

SEQ ID NO: 808 - RNA, 19 nt, Artificial Sequence
  source: /note="Description of Artificial Sequence: Synthetic oligonucleotide"
ucccggccacugcccuccu

SEQ ID NO: 809 - RNA, 19 nt, Artificial Sequence
  source: /note="Description of Artificial Sequence: Synthetic oligonucleotide"
uaccagggccgcgccccgg

SEQ ID NO: 810 - RNA, 19 nt, Artificial Sequence
  source: /note="Description of Artificial Sequence: Synthetic oligonucleotide"
uccaccgccgagaccaggg

SEQ ID NO: 811 - RNA, 19 nt, Artificial Sequence
  source: /note="Description of Artificial Sequence: Synthetic oligonucleotide"
ucuucuuacaggccaccgc

SEQ ID NO: 812 - RNA, 19 nt, Artificial Sequence
  source: /note="Description of Artificial Sequence: Synthetic oligonucleotide"
uagcauacaggccuucuua

SEQ ID NO: 813 - RNA, 19 nt, Artificial Sequence
  source: /note="Description of Artificial Sequence: Synthetic oligonucleotide"
ucacuggcccagcauacag

SEQ ID NO: 814 - RNA, 19 nt, Artificial Sequence
  source: /note="Description of Artificial Sequence: Synthetic oligonucleotide"
ucggccacugcucucacug

SEQ ID NO: 815 - RNA, 19 nt, Artificial Sequence
  source: /note="Description of Artificial Sequence: Synthetic oligonucleotide"
ucugcgcuugcggccacug

SEQ ID NO: 816 - RNA, 19 nt, Artificial Sequence
  source: /note="Description of Artificial Sequence: Synthetic oligonucleotide"
uuggcauccucccugcgcu

SEQ ID NO: 817 - RNA, 19 nt, Artificial Sequence
  source: /note="Description of Artificial Sequence: Synthetic oligonucleotide"
uugcuguggggcuguggca

SEQ ID NO: 818 - RNA, 19 nt, Artificial Sequence
  source: /note="Description of Artificial Sequence: Synthetic oligonucleotide"
auggagccugggugcugug

SEQ ID NO: 819 - RNA, 19 nt, Artificial Sequence
  source: /note="Description of Artificial Sequence: Synthetic oligonucleotide"
ucacuuccccauggagccu

SEQ ID NO: 820 - RNA, 19 nt, Artificial Sequence
  source: /note="Description of Artificial Sequence: Synthetic oligonucleotide"
acguguggggagcacuucc

SEQ ID NO: 821 - RNA, 19 nt, Artificial Sequence
  source: /note="Description of Artificial Sequence: Synthetic oligonucleotide"
aggcugcgagcacgugugg

SEQ ID NO: 822 - RNA, 19 nt, Artificial Sequence
  source: /note="Description of Artificial Sequence: Synthetic oligonucleotide"
uugccccgccaggcugcga

SEQ ID NO: 823 - RNA, 19 nt, Artificial Sequence
  source: /note="Description of Artificial Sequence: Synthetic oligonucleotide"
ugccaggccuccugccccg

SEQ ID NO: 824 - RNA, 19 nt, Artificial Sequence
  source: /note="Description of Artificial Sequence: Synthetic oligonucleotide"
ugguccugacaaggccagg

SEQ ID NO: 825 - RNA, 19 nt, Artificial Sequence
  source: /note="Description of Artificial Sequence: Synthetic oligonucleotide"
ucaggcggccuggguccug

SEQ ID NO: 826 - RNA, 19 nt, Artificial Sequence
  source: /note="Description of Artificial Sequence: Synthetic oligonucleotide"
ucagcgguauggcaggcgg

SEQ ID NO: 827 - RNA, 19 nt, Artificial Sequence
  source: /note="Description of Artificial Sequence: Synthetic oligonucleotide"
ucucuguuccccagcggua

SEQ ID NO: 828 - RNA, 19 nt, Artificial Sequence
  source: /note="Description of Artificial Sequence: Synthetic oligonucleotide"
ugaagaggcccgcucuguu

SEQ ID NO: 829 - RNA, 19 nt, Artificial Sequence
  source: /note="Description of Artificial Sequence: Synthetic oligonucleotide"
ugaaaaacugagggaagag

SEQ ID NO: 830 - RNA, 19 nt, Artificial Sequence
  source: /note="Description of Artificial Sequence: Synthetic oligonucleotide"
uggcugucccaccgaaaaa

SEQ ID NO: 831 - RNA, 19 nt, Artificial Sequence
  source: /note="Description of Artificial Sequence: Synthetic oligonucleotide"
agggcccuggggcuguccc

SEQ ID NO: 832 - RNA, 19 nt, Artificial Sequence
  source: /note="Description of Artificial Sequence: Synthetic oligonucleotide"
ucacccccguuagggcccu

SEQ ID NO: 833 - RNA, 19 nt, Artificial Sequence
  source: /note="Description of Artificial Sequence: Synthetic oligonucleotide"
uccugcuccugccgcaccc

SEQ ID NO: 834 - RNA, 19 nt, Artificial Sequence
  source: /note="Description of Artificial Sequence: Synthetic oligonucleotide"
agucucuguuccugcuccu

SEQ ID NO: 835 - RNA, 19 nt, Artificial Sequence
  source: /note="Description of Artificial Sequence: Synthetic oligonucleotide"
uggggcuuccagagucucu

SEQ ID NO: 836 - RNA, 19 nt, Artificial Sequence
  source: /note="Description of Artificial Sequence: Synthetic oligonucleotide"
ugagaaagguggggggcuu

SEQ ID NO: 837 - RNA, 19 nt, Artificial Sequence
  source: /note="Description of Artificial Sequence: Synthetic oligonucleotide"
aauugauuccagcgagaaa

SEQ ID NO: 838 - RNA, 19 nt, Artificial Sequence
  source: /note="Description of Artificial Sequence: Synthetic oligonucleotide"
uccuucugggaaauugauu

SEQ ID NO: 839 - RNA, 19 nt, Artificial Sequence
  source: /note="Description of Artificial Sequence: Synthetic oligonucleotide"
ugagcaacucccuucuggg

SEQ ID NO: 840 - RNA, 19 nt, Artificial Sequence
  source: /note="Description of Artificial Sequence: Synthetic oligonucleotide"
uaaaguccugagugagcaa

SEQ ID NO: 841 - RNA, 19 nt, Artificial Sequence
  source: /note="Description of Artificial Sequence: Synthetic oligonucleotide"
ugaaaugcaucaaaguccu

SEQ ID NO: 842 - RNA, 19 nt, Artificial Sequence
  source: /note="Description of Artificial Sequence: Synthetic oligonucleotide"
ucucugacaguguggaaau

SEQ ID NO: 843 - RNA, 19 nt, Artificial Sequence
  source: /note="Description of Artificial Sequence: Synthetic oligonucleotide"
uaggccaacagcucugaca

SEQ ID NO: 844 - RNA, 19 nt, Artificial Sequence
  source: /note="Description of Artificial Sequence: Synthetic oligonucleotide"
ugggcccaggcgaggccaa

SEQ ID NO: 845 - RNA, 19 nt, Artificial Sequence
  source: /note="Description of Artificial Sequence: Synthetic oligonucleotide"
ucccagagccugggcccag

SEQ ID NO: 846 - RNA, 19 nt, Artificial Sequence
  source: /note="Description of Artificial Sequence: Synthetic oligonucleotide"
agggcaccccuucccagag

SEQ ID NO: 847 - RNA, 19 nt, Artificial Sequence
  source: /note="Description of Artificial Sequence: Synthetic oligonucleotide"
uagcaggauccagagggca

SEQ ID NO: 848 - RNA, 19 nt, Artificial Sequence
  source: /note="Description of Artificial Sequence: Synthetic oligonucleotide"
aagugaggccacagcagga

SEQ ID NO: 849 - RNA, 19 nt, Artificial Sequence
  source: /note="Description of Artificial Sequence: Synthetic oligonucleotide"
aguucccagggaagugagg

SEQ ID NO: 850 - RNA, 19 nt, Artificial Sequence
  source: /note="Description of Artificial Sequence: Synthetic oligonucleotide"
acacaggaugaguucccag

SEQ ID NO: 851 - RNA, 19 nt, Artificial Sequence
  source: /note="Description of Artificial Sequence: Synthetic oligonucleotide"
agcugccuccccacacagg

SEQ ID NO: 852 - RNA, 19 nt, Artificial Sequence
  source: /note="Description of Artificial Sequence: Synthetic oligonucleotide"
agcuguuggagcugccucc

SEQ ID NO: 853 - RNA, 19 nt, Artificial Sequence
  source: /note="Description of Artificial Sequence: Synthetic oligonucleotide"
aggucuggucaagcuguug

SEQ ID NO: 854 - RNA, 19 nt, Artificial Sequence
  source: /note="Description of Artificial Sequence: Synthetic oligonucleotide"
ugcccaggucuaggucugg

SEQ ID NO: 855 - RNA, 19 nt, Artificial Sequence
  source: /note="Description of Artificial Sequence: Synthetic oligonucleotide"
ugcugcccuuuuggcccag

SEQ ID NO: 856 - RNA, 19 nt, Artificial Sequence
  source: /note="Description of Artificial Sequence: Synthetic oligonucleotide"
agcagccccuggcugcccu

SEQ ID NO: 857 - RNA, 19 nt, Artificial Sequence
  source: /note="Description of Artificial Sequence: Synthetic oligonucleotide"
acugggugaugagcagccc

SEQ ID NO: 858 - RNA, 19 nt, Artificial Sequence
  source: /note="Description of Artificial Sequence: Synthetic oligonucleotide"
aaaauggccaggacugggu

SEQ ID NO: 859 - RNA, 19 nt, Artificial Sequence
  source: /note="Description of Artificial Sequence: Synthetic oligonucleotide"
ucucaggcaagaaaauggc

SEQ ID NO: 860 - RNA, 19 nt, Artificial Sequence
  source: /note="Description of Artificial Sequence: Synthetic oligonucleotide"
uggccucuugagccucagg

SEQ ID NO: 861 - RNA, 19 nt, Artificial Sequence
  source: /note="Description of Artificial Sequence: Synthetic oligonucleotide"
auugcucccugggccucuu

SEQ ID NO: 862 - RNA, 19 nt, Artificial Sequence
  source: /note="Description of Artificial Sequence: Synthetic oligonucleotide"
agcccccucccauugcucc

SEQ ID NO: 863 - RNA, 19 nt, Artificial Sequence
  source: /note="Description of Artificial Sequence: Synthetic oligonucleotide"
uuccuccauggagcccccu

SEQ ID NO: 864 - RNA, 19 nt, Artificial Sequence
  source: /note="Description of Artificial Sequence: Synthetic oligonucleotide"
agcuugggacaccuccucc

SEQ ID NO: 865 - RNA, 19 nt, Artificial Sequence
  source: /note="Description of Artificial Sequence: Synthetic oligonucleotide"
ugguauucaaagcuuggga

SEQ ID NO: 866 - RNA, 19 nt, Artificial Sequence
  source: /note="Description of Artificial Sequence: Synthetic oligonucleotide"
aaaggucucuggggguauu

SEQ ID NO: 867 - RNA, 19 nt, Artificial Sequence
  source: /note="Description of Artificial Sequence: Synthetic oligonucleotide"
ugggagagaaaaggucucu

SEQ ID NO: 868 - RNA, 19 nt, Artificial Sequence
  source: /note="Description of Artificial Sequence: Synthetic oligonucleotide"
ucagugaugguaugggaga

SEQ ID NO: 869 - RNA, 19 nt, Artificial Sequence
  source: /note="Description of Artificial Sequence: Synthetic oligonucleotide"
aucacaagccacucaguga

SEQ ID NO: 870 - RNA, 19 nt, Artificial Sequence
  source: /note="Description of Artificial Sequence: Synthetic oligonucleotide"
uaucccagaaucacaagcc

SEQ ID NO: 871 - RNA, 19 nt, Artificial Sequence
  source: /note="Description of Artificial Sequence: Synthetic oligonucleotide"
ucugcgaggguccauccca

SEQ ID NO: 872 - RNA, 19 nt, Artificial Sequence
  source: /note="Description of Artificial Sequence: Synthetic oligonucleotide"
ucucuugcaccugcugcga

SEQ ID NO: 873 - RNA, 19 nt, Artificial Sequence
  source: /note="Description of Artificial Sequence: Synthetic oligonucleotide"
uggggcucugucucuugca

SEQ ID NO: 874 - RNA, 19 nt, Artificial Sequence
  source: /note="Description of Artificial Sequence: Synthetic oligonucleotide"
ucagaggcuugggggcucu

SEQ ID NO: 875 - RNA, 19 nt, Artificial Sequence
  source: /note="Description of Artificial Sequence: Synthetic oligonucleotide"
ugggccccuuggggcagag

SEQ ID NO: 876 - RNA, 19 nt, Artificial Sequence
  source: /note="Description of Artificial Sequence: Synthetic oligonucleotide"
uccccuuugugggccccuu

SEQ ID NO: 877 - RNA, 19 nt, Artificial Sequence
  source: /note="Description of Artificial Sequence: Synthetic oligonucleotide"
ucuggcccuucuccccuuu

SEQ ID NO: 878 - RNA, 19 nt, Artificial Sequence
  source: /note="Description of Artificial Sequence: Synthetic oligonucleotide"
uaagauguagggcuggccc

SEQ ID NO: 879 - RNA, 19 nt, Artificial Sequence
  source: /note="Description of Artificial Sequence: Synthetic oligonucleotide"
ugcuaugggagcugaagau

SEQ ID NO: 880 - RNA, 19 nt, Artificial Sequence
  source: /note="Description of Artificial Sequence: Synthetic oligonucleotide"
uugagccagcgcuauggga

SEQ ID NO: 881 - RNA, 19 nt, Artificial Sequence
  source: /note="Description of Artificial Sequence: Synthetic oligonucleotide"
uggguuucuuccugagcca

SEQ ID NO: 882 - RNA, 19 nt, Artificial Sequence
  source: /note="Description of Artificial Sequence: Synthetic oligonucleotide"
uugaaugcugcuugggguu

SEQ ID NO: 883 - RNA, 19 nt, Artificial Sequence
  source: /note="Description of Artificial Sequence: Synthetic oligonucleotide"
uggggugugcugaaugcug

SEQ ID NO: 884 - RNA, 19 nt, Artificial Sequence
  source: /note="Description of Artificial Sequence: Synthetic oligonucleotide"
uggguugucccuuggggug

SEQ ID NO: 885 - RNA, 19 nt, Artificial Sequence
  source: /note="Description of Artificial Sequence: Synthetic oligonucleotide"
ugucauaugaugggguugu

SEQ ID NO: 886 - RNA, 19 nt, Artificial Sequence
  source: /note="Description of Artificial Sequence: Synthetic oligonucleotide"
uguugggcauggagagggu

SEQ ID NO: 887 - RNA, 19 nt, Artificial Sequence
  source: /note="Description of Artificial Sequence: Synthetic oligonucleotide"
uacaaucuuagguugggca

SEQ ID NO: 888 - RNA, 19 nt, Artificial Sequence
  source: /note="Description of Artificial Sequence: Synthetic oligonucleotide"
aaaaaacccacacaaucuu

SEQ ID NO: 889 - RNA, 19 nt, Artificial Sequence
  source: /note="Description of Artificial Sequence: Synthetic oligonucleotide"
aacauuuuuaauuaaaaaa

SEQ ID NO: 890 - RNA, 19 nt, Artificial Sequence
  source: /note="Description of Artificial Sequence: Synthetic oligonucleotide"
aaaacuuuuaacauuuuua

SEQ ID NO: 891 - RNA, 19 nt, Artificial Sequence
  source: /note="Description of Artificial Sequence: Synthetic oligonucleotide"
uuuucauguuuaaaacuuu

SEQ ID NO: 892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccagccucaggcagcutt

SEQ ID NO: 893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcagcucuccauccatt

SEQ ID NO: 894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauccaagcagccguugatt

SEQ ID NO: 895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccguugcugccacaggatt

SEQ ID NO: 896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaggcgggccuuacgcuatt

SEQ ID NO: 897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacgcuccaaggcuacaatt

SEQ ID NO: 898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcuacagcaugugcuatt

SEQ ID NO: 899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcuaggccucagcagatt

SEQ ID NO: 900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcaggcaggagcaucutt

SEQ ID NO: 901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaucucugccucccaaatt

SEQ ID NO: 902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucccaaagcaucuaccutt

SEQ ID NO: 903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccccucggagagaugatt

SEQ ID NO: 904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagauggcgauggauguatt

SEQ ID NO: 905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaugucacaaggagccatt

SEQ ID NO: 906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagccaggcccagacaatt

SEQ ID NO: 907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucugguagagcagaucatt

SEQ ID NO: 908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagauccuggcagaguutt

SEQ ID NO: 909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaguuccagcugcaggatt

SEQ ID NO: 910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugcaggaggaggaccutt

SEQ ID NO: 911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaccugaagaaggugautt

SEQ ID NO: 912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggugaugagacggaugatt

SEQ ID NO: 913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggaugcagaaggagaugatt

SEQ ID NO: 914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggagauggaccgcggcatt

SEQ ID NO: 915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcggccugaggcuggagatt

SEQ ID NO: 916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggagacccaugaagagatt

SEQ ID NO: 917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaagaggccagugugatt

SEQ ID NO: 918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagugugaagaugcugccatt

SEQ ID NO: 919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugcccaccuacgugcatt

SEQ ID NO: 920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgugcgcuccaccccaatt

SEQ ID NO: 921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accccagaaggcucagaaatt

SEQ ID NO: 922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaagucggggacuucatt

SEQ ID NO: 923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggacuuccucucccugatt

SEQ ID NO: 924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccuggaccuggguggcatt

SEQ ID NO: 925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggguggcacuaacuucaatt

SEQ ID NO: 926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuucagggugaugcuggutt

SEQ ID NO: 927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugggagaaggugaggatt

SEQ ID NO: 928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguggagcgugaagaccatt

SEQ ID NO: 929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagauguacuccaucccatt

SEQ ID NO: 930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accggcacugcugagaugatt

SEQ ID NO: 931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugcucuucgacuacautt

SEQ ID NO: 932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgacuacaucucugaguatt

SEQ ID NO: 933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugagugcaucuccgacutt

SEQ ID NO: 934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgacuuccuggacaagatt

SEQ ID NO: 935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaagcaucagaugaaactt

SEQ ID NO: 936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugaaacacaagaagcutt

SEQ ID NO: 937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagcugccccugggcuutt

SEQ ID NO: 938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugggcuucaccuucucatt

SEQ ID NO: 939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuucuccuuuccugugatt

SEQ ID NO: 940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugaggcacgaagacautt

SEQ ID NO: 941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagacaucgauaagggcatt

SEQ ID NO: 942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaagggcauccuucucatt

SEQ ID NO: 943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucaacuggaccaaggatt

SEQ ID NO: 944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaagggcuucaaggccutt

SEQ ID NO: 945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaggccucaggagcagaatt

SEQ ID NO: 946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagcagaagggaacaautt

SEQ ID NO: 947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaugucguggggcuuatt

SEQ ID NO: 948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcuucugcgagacgatt

SEQ ID NO: 949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgagacgcuaucaaacggatt

SEQ ID NO: 950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacggagaggggacuuuatt

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggacuuugaaauggaugutt

SEQ ID NO: 952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaauggugaaugacacgatt

SEQ ID NO: 953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugacacgguggccacgatt

SEQ ID NO: 954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccacgaugaucuccugcutt

SEQ ID NO: 955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuacuacgaagacatt

SEQ ID NO: 956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcgaggucggcaugautt

SEQ ID NO: 957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaugaucgugggcacgatt

SEQ ID NO: 958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugggcacgggcugcaauatt

SEQ ID NO: 959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaugccugcuacaugatt

SEQ ID NO: 960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacauggaggagaugcagatt

SEQ ID NO: 961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugcagaauguggagcutt

SEQ ID NO: 962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggagcugguggagggatt

SEQ ID NO: 963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagggggacgagggccatt

SEQ ID NO: 964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagggccgcaugugcgucatt

SEQ ID NO: 965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgucaauaccgaguggatt

SEQ ID NO: 966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaguggggcgccuucggatt

SEQ ID NO: 967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuucggggacuccggcatt

SEQ ID NO: 968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggcgagcuggacgagutt

SEQ ID NO: 969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgaguuccugcuggagutt

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuggaguaugaccgccutt

SEQ ID NO: 971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccgccugguggacgagatt

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacgagagcucugcaaactt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcaaaccccggucagatt

SEQ ID NO: 974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucagcagcuguaugagatt

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugagaagcucauagguatt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauagguggcaaguacautt

SEQ ID NO: 977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguacaugggcgagcugatt

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgagcuggugcggcuugutt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuugugcugcucaggcutt

SEQ ID NO: 980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcucguggacgaaaatt

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacgaaaaccugcucuutt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucuuccacggggaggatt

SEQ ID NO: 983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaggccuccgagcagcutt

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgagcagcugcgcacacgatt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccuucgagacgcgcuuatt

SEQ ID NO: 986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcuucgugucgcaggugatt

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcagguggagagcgacatt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgacacgggcgaccgcatt

SEQ ID NO: 989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaccgcaagcagaucuaatt

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaucuacaacauccugatt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugagcacgcuggggcutt

SEQ ID NO: 992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggggcugcgacccucgatt

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacccucgaccaccgacutt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccgacugcgacaucguatt

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucgugcgccgcgccugatt

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcgccugcgagagcgugutt

SEQ ID NO: 997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgugucuacgcgcgcuatt

SEQ ID NO: 998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcgcugcgcacaugugcutt

SEQ ID NO: 999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugugcucggcggggcutt

SEQ ID NO: 1000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggggcuggcgggcgucautt

SEQ ID NO: 1001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggcgucaucaaccgcautt

SEQ ID NO: 1002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccgcaugcgcgagagcatt

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagccgcagcgaggacgutt

SEQ ID NO: 1004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaggacguaaugcgcauatt

SEQ ID NO: 1005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgcaucacugugggcgutt

SEQ ID NO: 1006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcguggauggcuccgutt

SEQ ID NO: 1007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcuccguguacaagcuatt

SEQ ID NO: 1008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaagcugcaccccagcutt

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagcuucaaggagcgguutt

SEQ ID NO: 1010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagcgguuccaugccaatt

SEQ ID NO: 1011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccagcgugcgcaggcutt

SEQ ID NO: 1012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcaggcugacgcccagcutt

SEQ ID NO: 1013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccagcugcgagaucaccutt

SEQ ID NO: 1014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaucaccuucaucgagutt

SEQ ID NO: 1015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgagucggaggagggcatt

SEQ ID NO: 1016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagggcaguggccgggatt

SEQ ID NO: 1017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggggcgcggcccugguatt

SEQ ID NO: 1018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuggucucggcgguggatt

SEQ ID NO: 1019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgguggccuguaagaagatt

SEQ ID NO: 1020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaaggccuguaugcuatt

SEQ ID NO: 1021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguaugcugggccagugatt

SEQ ID NO: 1022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagugagagcaguggccgatt

SEQ ID NO: 1023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguggccgcaagcgcagatt

SEQ ID NO: 1024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgcagggaggaugccaatt

SEQ ID NO: 1025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacagccccacagcaatt

SEQ ID NO: 1026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagcacccaggcuccautt

SEQ ID NO: 1027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuccauggggaagugatt

SEQ ID NO: 1028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagugcuccccacacgutt

SEQ ID NO: 1029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacacgugcucgcagccutt

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcagccuggcggggcaatt

SEQ ID NO: 1031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggggcaggaggccuggcatt

SEQ ID NO: 1032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggccuugucaggaccatt

SEQ ID NO: 1033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggacccaggccgccugatt

SEQ ID NO: 1034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccugccauaccgcugatt

SEQ ID NO: 1035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccgcuggggaacagagatt

SEQ ID NO: 1036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagagcgggccucuucatt

SEQ ID NO: 1037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuucccucaguuuuucatt

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuucggugggacagccatt

SEQ ID NO: 1039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggacagccccagggcccutt

SEQ ID NO: 1040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcccuaacgggggugatt

SEQ ID NO: 1041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggugcggcaggagcaggatt

SEQ ID NO: 1042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagcaggaacagagacutt

SEQ ID NO: 1043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagacucuggaagccccatt

SEQ ID NO: 1044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagccccccaccuuucucatt

SEQ ID NO: 1045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucucgcuggaaucaauutt

SEQ ID NO: 1046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucaauuucccagaaggatt

SEQ ID NO: 1047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccagaagggaguugcucatt

SEQ ID NO: 1048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcucacucaggacuuuatt

SEQ ID NO: 1049 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacuuugaugcauuucatt

SEQ ID NO: 1050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuccacacugucagagatt

SEQ ID NO: 1051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucagagcuguuggccuatt

SEQ ID NO: 1052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggccucgccugggcccatt

SEQ ID NO: 1053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggcccaggcucugggatt

SEQ ID NO: 1054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugggaaggggugcccutt

SEQ ID NO: 1055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccucuggauccugcuatt

SEQ ID NO: 1056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuguggccucacuutt

SEQ ID NO: 1057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucacuucccugggaacutt

SEQ ID NO: 1058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggaacucauccugugutt

SEQ ID NO: 1059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuguguggggaggcagcutt

SEQ ID NO: 1060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaggcagcuccaacagcutt

SEQ ID NO: 1061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacagcuugaccagaccutt

SEQ ID NO: 1062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagaccuagaccugggcatt

SEQ ID NO: 1063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggccaaaagggcagcatt

SEQ ID NO: 1064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcagccaggggcugcutt

SEQ ID NO: 1065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcugcucaucacccagutt

SEQ ID NO: 1066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccaguccuggccauuuutt

SEQ ID NO: 1067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccauuuucuugccugagatt

SEQ ID NO: 1068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugaggcucaagaggccatt

SEQ ID NO: 1069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaggcccagggagcaautt

SEQ ID NO: 1070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagcaaugggagggggcutt

SEQ ID NO: 1071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggggcuccauggaggaatt

SEQ ID NO: 1072 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaggaggugucccaagcutt

SEQ ID NO: 1073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaagcuuugaauaccatt

SEQ ID NO: 1074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauacccccagagaccuuutt

SEQ ID NO: 1075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaccuuuucucucccatt

SEQ ID NO: 1076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucccauaccaucacugatt

SEQ ID NO: 1077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacugaguggcuugugautt

SEQ ID NO: 1078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuugugauucugggauatt

SEQ ID NO: 1079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggauggacccucgcagatt

SEQ ID NO: 1080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcagcaggugcaagagatt

SEQ ID NO: 1081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaagagacagagccccatt

SEQ ID NO: 1082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcccccaagccucugatt

SEQ ID NO: 1083 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugccccaaggggcccatt

SEQ ID NO: 1084 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggggcccacaaaggggatt

SEQ ID NO: 1085 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggggagaagggccagatt

SEQ ID NO: 1086 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccagcccuacaucuuatt

SEQ ID NO: 1087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuucagcucccauagcatt

SEQ ID NO: 1088 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccauagcgcuggcucaatt

SEQ ID NO: 1089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcucaggaagaaacccatt

SEQ ID NO: 1090 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccccaagcagcauucaatt

SEQ ID NO: 1091 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcauucagcacaccccatt

SEQ ID NO: 1092 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccccaagggacaacccatt

SEQ ID NO: 1093 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaccccaucauaugacatt

SEQ ID NO: 1094 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccucuccaugcccaacatt

SEQ ID NO: 1095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccaaccuaagauuguatt

SEQ ID NO: 1096 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauuguguggguuuuuutt

SEQ ID NO: 1097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuaauuaaaaauguutt

SEQ ID NO: 1098 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaaauguuaaaaguuuutt

SEQ ID NO: 1099 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaguuuuaaacaugaaaatt

SEQ ID NO: 1100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugccugaggcuggcagtt

SEQ ID NO: 1101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauggagagcugccugatt

SEQ ID NO: 1102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaacggcugcuuggauggtt

SEQ ID NO: 1103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuguggcagcaacggcutt

SEQ ID NO: 1104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcguaaggcccgccugutt

SEQ ID NO: 1105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguagccuuggagcguaatt

SEQ ID NO: 1106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcacaugcuguagccuutt

SEQ ID NO: 1107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcugaggccuagcacatt

SEQ ID NO: 1108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugcuccugccugcugatt

SEQ ID NO: 1109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugggaggcagagaugcutt

SEQ ID NO: 1110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguagaugcuuugggaggtt

SEQ ID NO: 1111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucucuccgaggggcuatt

SEQ ID NO: 1112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacauccaucgccaucucutt

SEQ ID NO: 1113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcuccuugugacauccatt

SEQ ID NO: 1114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucugggccuggcuccutt

SEQ ID NO: 1115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucugcucuaccagagutt

SEQ ID NO: 1116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacucugccaggaucugcutt

SEQ ID NO: 1117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcagcuggaacucugtt

SEQ ID NO: 1118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguccuccuccugcagcutt

SEQ ID NO: 1119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaccuucuucagguccutt

SEQ ID NO: 1120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauccgucucaucaccuutt

SEQ ID NO: 1121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucuccuucugcauccgtt

SEQ ID NO: 1122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgcgguccaucuccuutt

SEQ ID NO: 1123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccagccucaggccgcgtt

SEQ ID NO: 1124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuucaugggucuccagtt

SEQ ID NO: 1125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacacuggccucuucaugtt

SEQ ID NO: 1126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcagcaucuucacacugtt

SEQ ID NO: 1127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacguaggugggcagcatt

SEQ ID NO: 1128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggguggagcgcacguatt

SEQ ID NO: 1129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucugagccuucuggggutt

SEQ ID NO: 1130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaguccccgacuucugatt

SEQ ID NO: 1131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagggagaggaagucccctt

SEQ ID NO: 1132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacccagguccagggatt

SEQ ID NO: 1133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaguuagugccacccatt

SEQ ID NO: 1134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagcaucacccugaagutt

SEQ ID NO: 1135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucaccuucucccaccutt

SEQ ID NO: 1136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggucuucacgcuccacugtt

SEQ ID NO: 1137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggauggaguacaucuggtt

SEQ ID NO: 1138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucucagcagugccggutt

SEQ ID NO: 1139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguagucgaagagcaucutt

SEQ ID NO: 1140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacucagagauguagucgatt

SEQ ID NO: 1141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucggagaugcacucagatt

SEQ ID NO: 1142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuguccaggaagucggatt

SEQ ID NO: 1143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucaucugaugcuuguctt

SEQ ID NO: 1144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuucuuguguuucaucutt

SEQ ID NO: 1145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcccaggggcagcuucutt

SEQ ID NO: 1146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaggugaagcccaggtt

SEQ ID NO: 1147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaggaaaggagaaggutt

SEQ ID NO: 1148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucuucgugccucacagtt

SEQ ID NO: 1149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuuaucgaugucuuctt

SEQ ID NO: 1150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaggaugcccuuauctt

SEQ ID NO: 1151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuugguccaguugagaatt

SEQ ID NO: 1152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccuugaagcccuuggutt

SEQ ID NO: 1153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcuccugaggccuugtt

SEQ ID NO: 1154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuguucccuucugcuccutt

SEQ ID NO: 1155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagccccacgacauuguutt

SEQ ID NO: 1156 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgucucgcagaagccccatt

SEQ ID NO: 1157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccguuugauagcgucucgtt

SEQ ID NO: 1158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaguccccucuccguuutt

SEQ ID NO: 1159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauccauuucaaaguccctt

SEQ ID NO: 1160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgugucauucaccauugctt

SEQ ID NO: 1161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguggccaccgugucauutt

SEQ ID NO: 1162 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaggagaucaucguggctt

SEQ ID NO: 1163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuucguaguagcaggatt

SEQ ID NO: 1164 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaugccgaccucgcacutt

SEQ ID NO: 1165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgugcccacgaucaugcctt

SEQ ID NO: 1166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauugcagcccgugcccactt

SEQ ID NO: 1167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauguagcaggcauugcatt

SEQ ID NO: 1168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcaucuccuccauguatt

SEQ ID NO: 1169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuccacauucugcaucutt

SEQ ID NO: 1170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccuccaccagcuccacatt

SEQ ID NO: 1171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcccucgucccccuccatt

SEQ ID NO: 1172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacgcacaugcggcccuctt

SEQ ID NO: 1173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccacucgguauugacgcatt

SEQ ID NO: 1174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgaaggcgccccacucgtt

SEQ ID NO: 1175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccggaguccccgaaggctt

SEQ ID NO: 1176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguccagcucgccggatt

SEQ ID NO: 1177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccagcaggaacucguctt

SEQ ID NO: 1178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcggucauacuccagcatt

SEQ ID NO: 1179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucguccaccaggcgguctt

SEQ ID NO: 1180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuugcagagcucucgucctt

SEQ ID NO: 1181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaccgggguuugcagatt

SEQ ID NO: 1182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucauacagcugcugacctt

SEQ ID NO: 1183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuaugagcuucucauatt

SEQ ID NO: 1184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguacuugccaccuaugatt

SEQ ID NO: 1185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcucgcccauguacuutt

SEQ ID NO: 1186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaagccgcaccagcucgctt

SEQ ID NO: 1187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccugagcagcacaagcctt

SEQ ID NO: 1188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuucguccacgagccugatt

SEQ ID NO: 1189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcagguuuucguccatt

SEQ ID NO: 1190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuccccguggaagagcatt

SEQ ID NO: 1191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugcucggaggccuccctt

SEQ ID NO: 1192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgugugcgcagcugcucgtt

SEQ ID NO: 1193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagcgcgucucgaaggcutt

SEQ ID NO: 1194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccugcgacacgaagcgtt

SEQ ID NO: 1195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgcucuccaccugcgatt

SEQ ID NO: 1196 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggucgcccgugucgcutt

SEQ ID NO: 1197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagaucugcuugcggucgtt

SEQ ID NO: 1198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggauguuguagaucugtt

SEQ ID NO: 1199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccagcgugcucaggatt

SEQ ID NO: 1200 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgagggucgcagccccagtt

SEQ ID NO: 1201 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucgguggucgagggucgtt

SEQ ID NO: 1202 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgaugucgcagucggugtt

SEQ ID NO: 1203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcgcggcgcacgaugtt

SEQ ID NO: 1204 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacgcucucgcaggcgcgtt

SEQ ID NO: 1205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcgcgcguagacacgcutt

SEQ ID NO: 1206 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacaugugcgcagcgcgtt

SEQ ID NO: 1207 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccgccgagcacaugutt

SEQ ID NO: 1208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augacgcccgccagccccgtt

SEQ ID NO: 1209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcgguugaugacgcccgtt

SEQ ID NO: 1210 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucucgcgcaugcgguutt

SEQ ID NO: 1211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguccucgcugcggcucutt

SEQ ID NO: 1212 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugcgcauuacguccucgtt

SEQ ID NO: 1213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcccacagugaugcgcatt

SEQ ID NO: 1214 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggagccauccacgcccatt

SEQ ID NO: 1215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcuuguacacggagccatt

SEQ ID NO: 1216 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuggggugcagcuuguatt

SEQ ID NO: 1217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccgcuccuugaagcuggtt

SEQ ID NO: 1218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcauggaaccgcuccutt

SEQ ID NO: 1219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccugcgcacgcuggcautt

SEQ ID NO: 1220 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugggcgucagccugcgtt

SEQ ID NO: 1221 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugaucucgcagcugggtt

SEQ ID NO: 1222 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgaugaaggugaucuctt

SEQ ID NO: 1223 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuccuccgacucgautt

SEQ ID NO: 1224 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccggccacugcccuccutt

SEQ ID NO: 1225 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccagggccgcgccccggtt

SEQ ID NO: 1226 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaccgccgagaccagggtt

SEQ ID NO: 1227 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuuacaggccaccgctt

SEQ ID NO: 1228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcauacaggccuucuuatt

SEQ ID NO: 1229 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuggcccagcauacagtt

SEQ ID NO: 1230 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggccacugcucucacugtt

SEQ ID NO: 1231 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcgcuugcggccacugtt

SEQ ID NO: 1232 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcauccucccugcgcutt

SEQ ID NO: 1233 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcuguggggcuguggcatt

SEQ ID NO: 1234 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggagccugggugcugugtt

SEQ ID NO: 1235 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuuccccauggagccutt

SEQ ID NO: 1236 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguguggggagcacuucctt

SEQ ID NO: 1237 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcugcgagcacguguggtt

SEQ ID NO: 1238 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccccgccaggcugcgatt

SEQ ID NO: 1239 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaggccuccugccccgtt

SEQ ID NO: 1240 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguccugacaaggccaggtt

SEQ ID NO: 1241 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcggccuggguccugtt

SEQ ID NO: 1242 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcgguauggcaggcggtt

SEQ ID NO: 1243 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuguuccccagcgguatt

SEQ ID NO: 1244 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagaggcccgcucuguutt

SEQ ID NO: 1245 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaaacugagggaagagtt

SEQ ID NO: 1246 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcugucccaccgaaaaatt

SEQ ID NO: 1247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcccuggggcuguccctt

SEQ ID NO: 1248 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacccccguuagggcccutt

SEQ ID NO: 1249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuccugccgcaccctt

SEQ ID NO: 1250 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucucuguuccugcuccutt

SEQ ID NO: 1251 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcuuccagagucucutt

SEQ ID NO: 1252 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaagguggggggcuutt

SEQ ID NO: 1253 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauugauuccagcgagaaatt

SEQ ID NO: 1254 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuucugggaaauugauutt

SEQ ID NO: 1255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcaacucccuucugggtt

SEQ ID NO: 1256 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaguccugagugagcaatt

SEQ ID NO: 1257 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaugcaucaaaguccutt

SEQ ID NO: 1258 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucugacaguguggaaautt

SEQ ID NO: 1259 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggccaacagcucugacatt

SEQ ID NO: 1260 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcccaggcgaggccaatt

SEQ ID NO: 1261 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccagagccugggcccagtt

SEQ ID NO: 1262 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcaccccuucccagagtt

SEQ ID NO: 1263 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcaggauccagagggcatt

SEQ ID NO: 1264 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagugaggccacagcaggatt

SEQ ID NO: 1265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguucccagggaagugaggtt

SEQ ID NO: 1266 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaggaugaguucccagtt

SEQ ID NO: 1267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugccuccccacacaggtt

SEQ ID NO: 1268 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuguuggagcugccucctt

SEQ ID NO: 1269 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucuggucaagcuguugtt

SEQ ID NO: 1270 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccaggucuaggucuggtt

SEQ ID NO: 1271 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugcccuuuuggcccagtt

SEQ ID NO: 1272 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagccccuggcugcccutt

SEQ ID NO: 1273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugggugaugagcagccctt

SEQ ID NO: 1274 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauggccaggacugggutt

SEQ ID NO: 1275 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaggcaagaaaauggctt

SEQ ID NO: 1276 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccucuugagccucaggtt

SEQ ID NO: 1277 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugcucccugggccucuutt

SEQ ID NO: 1278 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcccccucccauugcucctt

SEQ ID NO: 1279 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuccauggagcccccutt

SEQ ID NO: 1280 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuugggacaccuccucctt

SEQ ID NO: 1281 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguauucaaagcuugggatt

SEQ ID NO: 1282 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggucucuggggguauutt

SEQ ID NO: 1283 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggagagaaaaggucucutt

SEQ ID NO: 1284 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagugaugguaugggagatt

SEQ ID NO: 1285 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacaagccacucagugatt

SEQ ID NO: 1286 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucccagaaucacaagcctt

SEQ ID NO: 1287 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcgaggguccaucccatt

SEQ ID NO: 1288 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuugcaccugcugcgatt

SEQ ID NO: 1289 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcucugucucuugcatt

SEQ ID NO: 1290 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaggcuugggggcucutt

SEQ ID NO: 1291 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggccccuuggggcagagtt

SEQ ID NO: 1292 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccuuugugggccccuutt

SEQ ID NO: 1293 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggcccuucuccccuuutt

SEQ ID NO: 1294 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagauguagggcuggccctt

SEQ ID NO: 1295 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuaugggagcugaagautt

SEQ ID NO: 1296 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagccagcgcuaugggatt

SEQ ID NO: 1297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggguuucuuccugagccatt

SEQ ID NO: 1298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaugcugcuugggguutt

SEQ ID NO: 1299 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggugugcugaaugcugtt

SEQ ID NO: 1300 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggguugucccuuggggugtt

SEQ ID NO: 1301 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucauaugaugggguugutt

SEQ ID NO: 1302 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugggcauggagagggutt

SEQ ID NO: 1303 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaaucuuagguugggcatt

SEQ ID NO: 1304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaacccacacaaucuutt

SEQ ID NO: 1305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacauuuuuaauuaaaaaatt

SEQ ID NO: 1306 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacuuuuaacauuuuuatt

SEQ ID NO: 1307 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuucauguuuaaaacuuutt

SEQ ID NO: 1308 - RNA, 19 nt, Artificial Sequence
  source: /note="Description of Artificial Sequence: Synthetic oligonucleotide"
cugccagccucaggcagcu

SEQ ID NO: 1309 - RNA, 19 nt, Artificial Sequence
  source: /note="Description of Artificial Sequence: Synthetic oligonucleotide"
ucaggcagcucuccaucca

SEQ ID NO: 1310 - RNA, 19 nt, Artificial Sequence
  source: /note="Description of Artificial Sequence: Synthetic oligonucleotide"
ccauccaagcagccguugc

SEQ ID NO: 1311 - RNA, 19 nt, Artificial Sequence
  source: /note="Description of Artificial Sequence: Synthetic oligonucleotide"
agccguugcugccacaggc

SEQ ID NO: 1312 - RNA, 19 nt, Artificial Sequence
  source: /note="Description of Artificial Sequence: Synthetic oligonucleotide"
acaggcgggccuuacgcuc

SEQ ID NO: 1313 - RNA, 19 nt, Artificial Sequence
  source: /note="Description of Artificial Sequence: Synthetic oligonucleotide"
uuacgcuccaaggcuacag

SEQ ID NO: 1314 - RNA, 19 nt, Artificial Sequence
  source: /note="Description of Artificial Sequence: Synthetic oligonucleotide"
aaggcuacagcaugugcua

SEQ ID NO: 1315 - RNA, 19 nt, Artificial Sequence
  source: /note="Description of Artificial Sequence: Synthetic oligonucleotide"
ugugcuaggccucagcagg

SEQ ID NO: 1316 - RNA, 19 nt, Artificial Sequence
  source: /note="Description of Artificial Sequence: Synthetic oligonucleotide"
ucagcaggcaggagcaucu

SEQ ID NO: 1317 - RNA, 19 nt, Artificial Sequence
  source: /note="Description of Artificial Sequence: Synthetic oligonucleotide"
agcaucucugccucccaaa

SEQ ID NO: 1318 - RNA, 19 nt, Artificial Sequence
  source: /note="Description of Artificial Sequence: Synthetic oligonucleotide"
ccucccaaagcaucuaccu

SEQ ID NO: 1319 - RNA, 19 nt, Artificial Sequence
  source: /note="Description of Artificial Sequence: Synthetic oligonucleotide"
uagccccucggagagaugg

SEQ ID NO: 1320 - RNA, 19 nt, Artificial Sequence
  source: /note="Description of Artificial Sequence: Synthetic oligonucleotide"
agagauggcgauggauguc

SEQ ID NO: 1321 - RNA, 19 nt, Artificial Sequence
  source: /note="Description of Artificial Sequence: Synthetic oligonucleotide"
uggaugucacaaggagcca

SEQ ID NO: 1322 - RNA, 19 nt, Artificial Sequence
  source: /note="Description of Artificial Sequence: Synthetic oligonucleotide"
aggagccaggcccagacag

SEQ ID NO: 1323 - RNA, 19 nt, Artificial Sequence
  source: /note="Description of Artificial Sequence: Synthetic oligonucleotide"
acucugguagagcagaucc

SEQ ID NO: 1324 - RNA, 19 nt, Artificial Sequence
  source: /note="Description of Artificial Sequence: Synthetic oligonucleotide"
agcagauccuggcagaguu

SEQ ID NO: 1325 - RNA, 19 nt, Artificial Sequence
  source: /note="Description of Artificial Sequence: Synthetic oligonucleotide"
cagaguuccagcugcagga

SEQ ID NO: 1326 - RNA, 19 nt, Artificial Sequence
  source: /note="Description of Artificial Sequence: Synthetic oligonucleotide"
agcugcaggaggaggaccu

SEQ ID NO: 1327 - RNA, 19 nt, Artificial Sequence
  source: /note="Description of Artificial Sequence: Synthetic oligonucleotide"
aggaccugaagaaggugau

SEQ ID NO: 1328 - RNA, 19 nt, Artificial Sequence
  source: /note="Description of Artificial Sequence: Synthetic oligonucleotide"
aaggugaugagacggaugc

SEQ ID NO: 1329 - RNA, 19 nt, Artificial Sequence
  source: /note="Description of Artificial Sequence: Synthetic oligonucleotide"
cggaugcagaaggagaugg

SEQ ID NO: 1330 - RNA, 19 nt, Artificial Sequence
  source: /note="Description of Artificial Sequence: Synthetic oligonucleotide"
aaggagauggaccgcggcc

SEQ ID NO: 1331 - RNA, 19 nt, Artificial Sequence
  source: /note="Description of Artificial Sequence: Synthetic oligonucleotide"
cgcggccugaggcuggaga

SEQ ID NO: 1332 - RNA, 19 nt, Artificial Sequence
  source: /note="Description of Artificial Sequence: Synthetic oligonucleotide"
cuggagacccaugaagagg

SEQ ID NO: 1333 - RNA, 19 nt, Artificial Sequence
  source: /note="Description of Artificial Sequence: Synthetic oligonucleotide"
caugaagaggccaguguga

SEQ ID NO: 1334 - RNA, 19 nt, Artificial Sequence
  source: /note="Description of Artificial Sequence: Synthetic oligonucleotide"
cagugugaagaugcugccc

SEQ ID NO: 1335 - RNA, 19 nt, Artificial Sequence
  source: /note="Description of Artificial Sequence: Synthetic oligonucleotide"
ugcugcccaccuacgugcg

SEQ ID NO: 1336 - RNA, 19 nt, Artificial Sequence
  source: /note="Description of Artificial Sequence: Synthetic oligonucleotide"
uacgugcgcuccaccccag

SEQ ID NO: 1337 - RNA, 19 nt, Artificial Sequence
  source: /note="Description of Artificial Sequence: Synthetic oligonucleotide"
accccagaaggcucagaag

SEQ ID NO: 1338 - RNA, 19 nt, Artificial Sequence
  source: /note="Description of Artificial Sequence: Synthetic oligonucleotide"
ucagaagucggggacuucc

SEQ ID NO: 1339 - RNA, 19 nt, Artificial Sequence
  source: /note="Description of Artificial Sequence: Synthetic oligonucleotide"
ggggacuuccucucccugg

SEQ ID NO: 1340 - RNA, 19 nt, Artificial Sequence
  source: /note="Description of Artificial Sequence: Synthetic oligonucleotide"
ucccuggaccuggguggca

SEQ ID NO: 1341 - RNA, 19 nt, Artificial Sequence
  source: /note="Description of Artificial Sequence: Synthetic oligonucleotide"
uggguggcacuaacuucag

SEQ ID NO: 1342 - RNA, 19 nt, Artificial Sequence
  source: /note="Description of Artificial Sequence: Synthetic oligonucleotide"
acuucagggugaugcuggu

SEQ ID NO: 1343 - RNA, 19 nt, Artificial Sequence
  source: /note="Description of Artificial Sequence: Synthetic oligonucleotide"
aggugggagaaggugagga

SEQ ID NO: 1344 - RNA, 19 nt, Artificial Sequence
  source: /note="Description of Artificial Sequence: Synthetic oligonucleotide"
caguggagcgugaagacca

SEQ ID NO: 1345 - RNA, 19 nt, Artificial Sequence
  source: /note="Description of Artificial Sequence: Synthetic oligonucleotide"
ccagauguacuccaucccc

SEQ ID NO: 1346 - RNA, 19 nt, Artificial Sequence
  source: /note="Description of Artificial Sequence: Synthetic oligonucleotide"
accggcacugcugagaugc

SEQ ID NO: 1347 - RNA, 19 nt, Artificial Sequence
  source: /note="Description of Artificial Sequence: Synthetic oligonucleotide"
agaugcucuucgacuacau

SEQ ID NO: 1348 - RNA, 19 nt, Artificial Sequence
  source: /note="Description of Artificial Sequence: Synthetic oligonucleotide"
ucgacuacaucucugagug

SEQ ID NO: 1349 - RNA, 19 nt, Artificial Sequence
  source: /note="Description of Artificial Sequence: Synthetic oligonucleotide"
ucugagugcaucuccgacu

SEQ ID NO: 1350 - RNA, 19 nt, Artificial Sequence
  source: /note="Description of Artificial Sequence: Synthetic oligonucleotide"
uccgacuuccuggacaagc

SEQ ID NO: 1351 - RNA, 19 nt, Artificial Sequence
  source: /note="Description of Artificial Sequence: Synthetic oligonucleotide"
gacaagcaucagaugaaac

SEQ ID NO: 1352 - RNA, 19 nt, Artificial Sequence
  source: /note="Description of Artificial Sequence: Synthetic oligonucleotide"
agaugaaacacaagaagcu

SEQ ID NO: 1353 - RNA, 19 nt, Artificial Sequence
  source: /note="Description of Artificial Sequence: Synthetic oligonucleotide"
agaagcugccccugggcuu

SEQ ID NO: 1354 - RNA, 19 nt, Artificial Sequence
  source: /note="Description of Artificial Sequence: Synthetic oligonucleotide"
ccugggcuucaccuucucc

SEQ ID NO: 1355 - RNA, 19 nt, Artificial Sequence
  source: /note="Description of Artificial Sequence: Synthetic oligonucleotide"
accuucuccuuuccuguga

SEQ ID NO: 1356 - RNA, 19 nt, Artificial Sequence
  source: /note="Description of Artificial Sequence: Synthetic oligonucleotide"
cugugaggcacgaagacau

SEQ ID NO: 1357 - RNA, 19 nt, Artificial Sequence
  source: /note="Description of Artificial Sequence: Synthetic oligonucleotide"
gaagacaucgauaagggca

SEQ ID NO: 1358 - RNA, 19 nt, Artificial Sequence
  source: /note="Description of Artificial Sequence: Synthetic oligonucleotide"
gauaagggcauccuucuca

SEQ ID NO: 1359 - RNA, 19 nt, Artificial Sequence
  source: /note="Description of Artificial Sequence: Synthetic oligonucleotide"
uucucaacuggaccaaggg

SEQ ID NO: 1360 - RNA, 19 nt, Artificial Sequence
  source: /note="Description of Artificial Sequence: Synthetic oligonucleotide"
accaagggcuucaaggccu

SEQ ID NO: 1361 - RNA, 19 nt, Artificial Sequence
  source: /note="Description of Artificial Sequence: Synthetic oligonucleotide"
caaggccucaggagcagaa

SEQ ID NO: 1362 - RNA, 19 nt, Artificial Sequence
  source: /note="Description of Artificial Sequence: Synthetic oligonucleotide"
aggagcagaagggaacaau

SEQ ID NO: 1363 - RNA, 19 nt, Artificial Sequence
  source: /note="Description of Artificial Sequence: Synthetic oligonucleotide"
aacaaugucguggggcuuc

SEQ ID NO: 1364 - RNA, 19 nt, Artificial Sequence
  source: /note="Description of Artificial Sequence: Synthetic oligonucleotide"
uggggcuucugcgagacgc

SEQ ID NO: 1365 - RNA, 19 nt, Artificial Sequence
  source: /note="Description of Artificial Sequence: Synthetic oligonucleotide"
cgagacgcuaucaaacgga

SEQ ID NO: 1366 - RNA, 19 nt, Artificial Sequence
  source: /note="Description of Artificial Sequence: Synthetic oligonucleotide"
aaacggagaggggacuuug

SEQ ID NO: 1367 - RNA, 19 nt, Artificial Sequence
  source: /note="Description of Artificial Sequence: Synthetic oligonucleotide"
gggacuuugaaauggaugu

SEQ ID NO: 1368 - RNA, 19 nt, Artificial Sequence
  source: /note="Description of Artificial Sequence: Synthetic oligonucleotide"
gcaauggugaaugacacgg

SEQ ID NO: 1369 - RNA, 19 nt, Artificial Sequence
  source: /note="Description of Artificial Sequence: Synthetic oligonucleotide"
aaugacacgguggccacga

SEQ ID NO: 1370 - RNA, 19 nt, Artificial Sequence
  source: /note="Description of Artificial Sequence: Synthetic oligonucleotide"
gccacgaugaucuccugcu

SEQ ID NO: 1371 - RNA, 19 nt, Artificial Sequence
  source: /note="Description of Artificial Sequence: Synthetic oligonucleotide"
uccugcuacuacgaagacc

SEQ ID NO: 1372 - RNA, 19 nt, Artificial Sequence
  source: /note="Description of Artificial Sequence: Synthetic oligonucleotide"
agugcgaggucggcaugau

SEQ ID NO: 1373 - RNA, 19 nt, Artificial Sequence
  source: /note="Description of Artificial Sequence: Synthetic oligonucleotide"
ggcaugaucgugggcacgg

SEQ ID NO: 1374 - RNA, 19 nt, Artificial Sequence
  source: /note="Description of Artificial Sequence: Synthetic oligonucleotide"
gugggcacgggcugcaaug

SEQ ID NO: 1375 - RNA, 19 nt, Artificial Sequence
  source: /note="Description of Artificial Sequence: Synthetic oligonucleotide"
ugcaaugccugcuacaugg

SEQ ID NO: 1376 - RNA, 19 nt, Artificial Sequence
  source: /note="Description of Artificial Sequence: Synthetic oligonucleotide"
uacauggaggagaugcaga

SEQ ID NO: 1377 - RNA, 19 nt, Artificial Sequence
  source: /note="Description of Artificial Sequence: Synthetic oligonucleotide"
agaugcagaauguggagcu

SEQ ID NO: 1378 - RNA, 19 nt, Artificial Sequence
  source: /note="Description of Artificial Sequence: Synthetic oligonucleotide"
uguggagcugguggagggg

SEQ ID NO: 1379 - RNA, 19 nt, Artificial Sequence
  source: /note="Description of Artificial Sequence: Synthetic oligonucleotide"
uggagggggacgagggccg

SEQ ID NO: 1380 - RNA, 19 nt, Artificial Sequence
  source: /note="Description of Artificial Sequence: Synthetic oligonucleotide"
gagggccgcaugugcguca

SEQ ID NO: 1381 - RNA, 19 nt, Artificial Sequence
  source: /note="Description of Artificial Sequence: Synthetic oligonucleotide"
ugcgucaauaccgaguggg

SEQ ID NO: 1382 - RNA, 19 nt, Artificial Sequence
  source: /note="Description of Artificial Sequence: Synthetic oligonucleotide"
cgaguggggcgccuucggg

SEQ ID NO: 1383 - RNA, 19 nt, Artificial Sequence
  source: /note="Description of Artificial Sequence: Synthetic oligonucleotide"
gccuucggggacuccggcg

SEQ ID NO: 1384 - RNA, 19 nt, Artificial Sequence
  source: /note="Description of Artificial Sequence: Synthetic oligonucleotide"
uccggcgagcuggacgagu

SEQ ID NO: 1385 - RNA, 19 nt, Artificial Sequence
  source: /note="Description of Artificial Sequence: Synthetic oligonucleotide"
gacgaguuccugcuggagu

SEQ ID NO: 1386 - RNA, 19 nt, Artificial Sequence
  source: /note="Description of Artificial Sequence: Synthetic oligonucleotide"
ugcuggaguaugaccgccu

SEQ ID NO: 1387 - RNA, 19 nt, Artificial Sequence
  source: /note="Description of Artificial Sequence: Synthetic oligonucleotide"
gaccgccugguggacgaga

SEQ ID NO: 1388 - RNA, 19 nt, Artificial Sequence
  source: /note="Description of Artificial Sequence: Synthetic oligonucleotide"
ggacgagagcucugcaaac

SEQ ID NO: 1389 - RNA, 19 nt, Artificial Sequence
  source: /note="Description of Artificial Sequence: Synthetic oligonucleotide"
ucugcaaaccccggucagc

SEQ ID NO: 1390 - RNA, 19 nt, Artificial Sequence
  source: /note="Description of Artificial Sequence: Synthetic oligonucleotide"
ggucagcagcuguaugaga

SEQ ID NO: 1391 - RNA, 19 nt, Artificial Sequence
  source: /note="Description of Artificial Sequence: Synthetic oligonucleotide"
uaugagaagcucauaggug

SEQ ID NO: 1392 - RNA, 19 nt, Artificial Sequence
  source: /note="Description of Artificial Sequence: Synthetic oligonucleotide"
ucauagguggcaaguacau

SEQ ID NO: 1393 - RNA, 19 nt, Artificial Sequence
  source: /note="Description of Artificial Sequence: Synthetic oligonucleotide"
aaguacaugggcgagcugg

SEQ ID NO: 1394 - RNA, 19 nt, Artificial Sequence
  source: /note="Description of Artificial Sequence: Synthetic oligonucleotide"
gcgagcuggugcggcuugu

SEQ ID NO: 1395 - RNA, 19 nt, Artificial Sequence
  source: /note="Description of Artificial Sequence: Synthetic oligonucleotide"
ggcuugugcugcucaggcu

SEQ ID NO: 1396 - RNA, 19 nt, Artificial Sequence
  source: /note="Description of Artificial Sequence: Synthetic oligonucleotide"
ucaggcucguggacgaaaa

SEQ ID NO: 1397 - RNA, 19 nt, Artificial Sequence
  source: /note="Description of Artificial Sequence: Synthetic oligonucleotide"
uggacgaaaaccugcucuu

SEQ ID NO: 1398 - RNA, 19 nt, Artificial Sequence
  source: /note="Description of Artificial Sequence: Synthetic oligonucleotide"
ugcucuuccacggggaggc

SEQ ID NO: 1399 - RNA, 19 nt, Artificial Sequence
  source: /note="Description of Artificial Sequence: Synthetic oligonucleotide"
gggaggccuccgagcagcu

SEQ ID NO: 1400 - RNA, 19 nt, Artificial Sequence
  source: /note="Description of Artificial Sequence: Synthetic oligonucleotide"
cgagcagcugcgcacacgc

SEQ ID NO: 1401 - RNA, 19 nt, Artificial Sequence
  source: /note="Description of Artificial Sequence: Synthetic oligonucleotide"
agccuucgagacgcgcuuc

SEQ ID NO: 1402 - RNA, 19 nt, Artificial Sequence
  source: /note="Description of Artificial Sequence: Synthetic oligonucleotide"
cgcuucgugucgcaggugg

SEQ ID NO: 1403 - RNA, 19 nt, Artificial Sequence
  source: /note="Description of Artificial Sequence: Synthetic oligonucleotide"
ucgcagguggagagcgaca

SEQ ID NO: 1404 - RNA, 19 nt, Artificial Sequence
  source: /note="Description of Artificial Sequence: Synthetic oligonucleotide"
agcgacacgggcgaccgca

SEQ ID NO: 1405 - RNA, 19 nt, Artificial Sequence
  source: /note="Description of Artificial Sequence: Synthetic oligonucleotide"
cgaccgcaagcagaucuac

SEQ ID NO: 1406 - RNA, 19 nt, Artificial Sequence
  source: /note="Description of Artificial Sequence: Synthetic oligonucleotide"
cagaucuacaacauccuga

SEQ ID NO: 1407 - RNA, 19 nt, Artificial Sequence
  source: /note="Description of Artificial Sequence: Synthetic oligonucleotide"
uccugagcacgcuggggcu

SEQ ID NO: 1408 - RNA, 19 nt, Artificial Sequence
  source: /note="Description of Artificial Sequence: Synthetic oligonucleotide"
cuggggcugcgacccucga

SEQ ID NO: 1409 - RNA, 19 nt, Artificial Sequence
  source: /note="Description of Artificial Sequence: Synthetic oligonucleotide"
cgacccucgaccaccgacu

SEQ ID NO: 1410 - RNA, 19 nt, Artificial Sequence
  source: /note="Description of Artificial Sequence: Synthetic oligonucleotide"
caccgacugcgacaucgug

SEQ ID NO: 1411 - RNA, 19 nt, Artificial Sequence
  source: /note="Description of Artificial Sequence: Synthetic oligonucleotide"
caucgugcgccgcgccugc

SEQ ID NO: 1412 - RNA, 19 nt, Artificial Sequence
  source: /note="Description of Artificial Sequence: Synthetic oligonucleotide"
cgcgccugcgagagcgugu

SEQ ID NO: 1413 - RNA, 19 nt, Artificial Sequence
  source: /note="Description of Artificial Sequence: Synthetic oligonucleotide"
agcgugucuacgcgcgcug

SEQ ID NO: 1414 - RNA, 19 nt, Artificial Sequence
  source: /note="Description of Artificial Sequence: Synthetic oligonucleotide"
cgcgcugcgcacaugugcu

SEQ ID NO: 1415 - RNA, 19 nt, Artificial Sequence
  source: /note="Description of Artificial Sequence: Synthetic oligonucleotide"
acaugugcucggcggggcu

SEQ ID NO: 1416 - RNA, 19 nt, Artificial Sequence
  source: /note="Description of Artificial Sequence: Synthetic oligonucleotide"
cggggcuggcgggcgucau

SEQ ID NO: 1417 - RNA, 19 nt, Artificial Sequence
  source: /note="Description of Artificial Sequence: Synthetic oligonucleotide"
cgggcgucaucaaccgcau

SEQ ID NO: 1418 - RNA, 19 nt, Artificial Sequence
  source: /note="Description of Artificial Sequence: Synthetic oligonucleotide"
aaccgcaugcgcgagagcc

SEQ ID NO: 1419 - RNA, 19 nt, Artificial Sequence
  source: /note="Description of Artificial Sequence: Synthetic oligonucleotide"
agagccgcagcgaggacgu

SEQ ID NO: 1420 - RNA, 19 nt, Artificial Sequence
  source: /note="Description of Artificial Sequence: Synthetic oligonucleotide"
cgaggacguaaugcgcauc

SEQ ID NO: 1421 - RNA, 19 nt, Artificial Sequence
  source: /note="Description of Artificial Sequence: Synthetic oligonucleotide"
ugcgcaucacugugggcgu

SEQ ID NO: 1422 - RNA, 19 nt, Artificial Sequence
  source: /note="Description of Artificial Sequence: Synthetic oligonucleotide"
ugggcguggauggcuccgu

SEQ ID NO: 1423 - RNA, 19 nt, Artificial Sequence
  source: /note="Description of Artificial Sequence: Synthetic oligonucleotide"
uggcuccguguacaagcug

SEQ ID NO: 1424 - RNA, 19 nt, Artificial Sequence
  source: /note="Description of Artificial Sequence: Synthetic oligonucleotide"
uacaagcugcaccccagcu

SEQ ID NO: 1425 - RNA, 19 nt, Artificial Sequence
  source: /note="Description of Artificial Sequence: Synthetic oligonucleotide"
ccagcuucaaggagcgguu

SEQ ID NO: 1426 - RNA, 19 nt, Artificial Sequence
  source: /note="Description of Artificial Sequence: Synthetic oligonucleotide"
aggagcgguuccaugccag

SEQ ID NO: 1427 - RNA, 19 nt, Artificial Sequence
  source: /note="Description of Artificial Sequence: Synthetic oligonucleotide"
augccagcgugcgcaggcu

SEQ ID NO: 1428 - RNA, 19 nt, Artificial Sequence
  source: /note="Description of Artificial Sequence: Synthetic oligonucleotide"
cgcaggcugacgcccagcu

SEQ ID NO: 1429 - RNA, 19 nt, Artificial Sequence
  source: /note="Description of Artificial Sequence: Synthetic oligonucleotide"
cccagcugcgagaucaccu

SEQ ID NO: 1430 - RNA, 19 nt, Artificial Sequence
  source: /note="Description of Artificial Sequence: Synthetic oligonucleotide"
gagaucaccuucaucgagu

SEQ ID NO: 1431 - RNA, 19 nt, Artificial Sequence
  source: /note="Description of Artificial Sequence: Synthetic oligonucleotide"
aucgagucggaggagggca

SEQ ID NO: 1432 - RNA, 19 nt, Artificial Sequence
  source: /note="Description of Artificial Sequence: Synthetic oligonucleotide"
aggagggcaguggccgggg

SEQ ID NO: 1433 - RNA, 19 nt, Artificial Sequence
  source: /note="Description of Artificial Sequence: Synthetic oligonucleotide"
ccggggcgcggcccugguc

SEQ ID NO: 1434 - RNA, 19 nt, Artificial Sequence
  source: /note="Description of Artificial Sequence: Synthetic oligonucleotide"
cccuggucucggcgguggc

SEQ ID NO: 1435 - RNA, 19 nt, Artificial Sequence
  source: /note="Description of Artificial Sequence: Synthetic oligonucleotide"
gcgguggccuguaagaagg

SEQ ID NO: 1436 - RNA, 19 nt, Artificial Sequence
  source: /note="Description of Artificial Sequence: Synthetic oligonucleotide"
uaagaaggccuguaugcug

SEQ ID NO: 1437 - RNA, 19 nt, Artificial Sequence
  source: /note="Description of Artificial Sequence: Synthetic oligonucleotide"
cuguaugcugggccaguga

SEQ ID NO: 1438 - RNA, 19 nt, Artificial Sequence
  source: /note="Description of Artificial Sequence: Synthetic oligonucleotide"
cagugagagcaguggccgc

SEQ ID NO: 1439 - RNA, 19 nt, Artificial Sequence
  source: /note="Description of Artificial Sequence: Synthetic oligonucleotide"
caguggccgcaagcgcagg

SEQ ID NO: 1440 - RNA, 19 nt, Artificial Sequence
  source: /note="Description of Artificial Sequence: Synthetic oligonucleotide"
agcgcagggaggaugccac

SEQ ID NO: 1441 - RNA, 19 nt, Artificial Sequence
  source: /note="Description of Artificial Sequence: Synthetic oligonucleotide"
ugccacagccccacagcac

SEQ ID NO: 1442 - RNA, 19 nt, Artificial Sequence
  source: /note="Description of Artificial Sequence: Synthetic oligonucleotide"
cacagcacccaggcuccau

SEQ ID NO: 1443 - RNA, 19 nt, Artificial Sequence
  source: /note="Description of Artificial Sequence: Synthetic oligonucleotide"
aggcuccauggggaagugc

SEQ ID NO: 1444 - RNA, 19 nt, Artificial Sequence
  source: /note="Description of Artificial Sequence: Synthetic oligonucleotide"
ggaagugcuccccacacgu

SEQ ID NO: 1445 - RNA, 19 nt, Artificial Sequence
  source: /note="Description of Artificial Sequence: Synthetic oligonucleotide"
ccacacgugcucgcagccu

SEQ ID NO: 1446 - RNA, 19 nt, Artificial Sequence
  source: /note="Description of Artificial Sequence: Synthetic oligonucleotide"
ucgcagccuggcggggcag

SEQ ID NO: 1447 - RNA, 19 nt, Artificial Sequence
  source: /note="Description of Artificial Sequence: Synthetic oligonucleotide"
cggggcaggaggccuggcc

SEQ ID NO: 1448 - RNA, 19 nt, Artificial Sequence
  source: /note="Description of Artificial Sequence: Synthetic oligonucleotide"
ccuggccuugucaggaccc

SEQ ID NO: 1449 - RNA, 19 nt, Artificial Sequence
  source: /note="Description of Artificial Sequence: Synthetic oligonucleotide"
caggacccaggccgccugc

SEQ ID NO: 1450 - RNA, 19 nt, Artificial Sequence
  source: /note="Description of Artificial Sequence: Synthetic oligonucleotide"
ccgccugccauaccgcugg

SEQ ID NO: 1451 - RNA, 19 nt, Artificial Sequence
  source: /note="Description of Artificial Sequence: Synthetic oligonucleotide"
uaccgcuggggaacagagc

SEQ ID NO: 1452 - RNA, 19 nt, Artificial Sequence
  source: /note="Description of Artificial Sequence: Synthetic oligonucleotide"
aacagagcgggccucuucc

SEQ ID NO: 1453 - RNA, 19 nt, Artificial Sequence
  source: /note="Description of Artificial Sequence: Synthetic oligonucleotide"
cucuucccucaguuuuucg

SEQ ID NO: 1454 - RNA, 19 nt, Artificial Sequence
  source: /note="Description of Artificial Sequence: Synthetic oligonucleotide"
uuuuucggugggacagccc

SEQ ID NO: 1455 - RNA, 19 nt, Artificial Sequence
  source: /note="Description of Artificial Sequence: Synthetic oligonucleotide"
gggacagccccagggcccu

SEQ ID NO: 1456 - RNA, 19 nt, Artificial Sequence
  source: /note="Description of Artificial Sequence: Synthetic oligonucleotide"
agggcccuaacgggggugc

SEQ ID NO: 1457 - RNA, 19 nt, Artificial Sequence
  source: /note="Description of Artificial Sequence: Synthetic oligonucleotide"
gggugcggcaggagcagga

SEQ ID NO: 1458 - RNA, 19 nt, Artificial Sequence
  source: /note="Description of Artificial Sequence: Synthetic oligonucleotide"
aggagcaggaacagagacu

SEQ ID NO: 1459 - RNA, 19 nt, Artificial Sequence
  source: /note="Description of Artificial Sequence: Synthetic oligonucleotide"
agagacucuggaagccccc

SEQ ID NO: 1460 - RNA, 19 nt, Artificial Sequence
  source: /note="Description of Artificial Sequence: Synthetic oligonucleotide"
aagccccccaccuuucucg

SEQ ID NO: 1461 - RNA, 19 nt, Artificial Sequence
  source: /note="Description of Artificial Sequence: Synthetic oligonucleotide"
uuucucgcuggaaucaauu

SEQ ID NO: 1462 - RNA, 19 nt, Artificial Sequence
  source: /note="Description of Artificial Sequence: Synthetic oligonucleotide"
aaucaauuucccagaaggg

SEQ ID NO: 1463 - RNA, 19 nt, Artificial Sequence
  source: /note="Description of Artificial Sequence: Synthetic oligonucleotide"
cccagaagggaguugcuca

SEQ ID NO: 1464 - RNA, 19 nt, Artificial Sequence
  source: /note="Description of Artificial Sequence: Synthetic oligonucleotide"
uugcucacucaggacuuug

SEQ ID NO: 1465 - RNA, 19 nt, Artificial Sequence
  source: /note="Description of Artificial Sequence: Synthetic oligonucleotide"
aggacuuugaugcauuucc

SEQ ID NO: 1466 - RNA, 19 nt, Artificial Sequence
  source: /note="Description of Artificial Sequence: Synthetic oligonucleotide"
auuuccacacugucagagc

SEQ ID NO: 1467 - RNA, 19 nt, Artificial Sequence
  source: /note="Description of Artificial Sequence: Synthetic oligonucleotide"
ugucagagcuguuggccuc

SEQ ID NO: 1468 - RNA, 19 nt, Artificial Sequence
  source: /note="Description of Artificial Sequence: Synthetic oligonucleotide"
uuggccucgccugggccca

SEQ ID NO: 1469 - RNA, 19 nt, Artificial Sequence
  source: /note="Description of Artificial Sequence: Synthetic oligonucleotide"
cugggcccaggcucuggga

SEQ ID NO: 1470 - RNA, 19 nt, Artificial Sequence
  source: /note="Description of Artificial Sequence: Synthetic oligonucleotide"
cucugggaaggggugcccu

SEQ ID NO: 1471 - RNA, 19 nt, Artificial Sequence
  source: /note="Description of Artificial Sequence: Synthetic oligonucleotide"
ugcccucuggauccugcug

SEQ ID NO: 1472 - RNA, 19 nt, Artificial Sequence
  source: /note="Description of Artificial Sequence: Synthetic oligonucleotide"
uccugcuguggccucacuu

SEQ ID NO: 1473 - RNA, 19 nt, Artificial Sequence
  source: /note="Description of Artificial Sequence: Synthetic oligonucleotide"
ccucacuucccugggaacu

SEQ ID NO: 1474 - RNA, 19 nt, Artificial Sequence
  source: /note="Description of Artificial Sequence: Synthetic oligonucleotide"
cugggaacucauccugugu

SEQ ID NO: 1475 - RNA, 19 nt, Artificial Sequence
  source: /note="Description of Artificial Sequence: Synthetic oligonucleotide"
ccuguguggggaggcagcu

SEQ ID NO: 1476 - RNA, 19 nt, Artificial Sequence
  source: /note="Description of Artificial Sequence: Synthetic oligonucleotide"
ggaggcagcuccaacagcu

SEQ ID NO: 1477 - RNA, 19 nt, Artificial Sequence
  source: /note="Description of Artificial Sequence: Synthetic oligonucleotide"
caacagcuugaccagaccu

SEQ ID NO: 1478 - RNA, 19 nt, Artificial Sequence
  source: /note="Description of Artificial Sequence: Synthetic oligonucleotide"
ccagaccuagaccugggcc

SEQ ID NO: 1479 - RNA, 19 nt, Artificial Sequence
  source: /note="Description of Artificial Sequence: Synthetic oligonucleotide"
cugggccaaaagggcagcc

SEQ ID NO: 1480 - RNA, 19 nt, Artificial Sequence
  source: /note="Description of Artificial Sequence: Synthetic oligonucleotide"
agggcagccaggggcugcu

SEQ ID NO: 1481 - RNA, 19 nt, Artificial Sequence
  source: /note="Description of Artificial Sequence: Synthetic oligonucleotide"
gggcugcucaucacccagu

SEQ ID NO: 1482 - RNA, 19 nt, Artificial Sequence
  source: /note="Description of Artificial Sequence: Synthetic oligonucleotide"
acccaguccuggccauuuu

SEQ ID NO: 1483 - RNA, 19 nt, Artificial Sequence
  source: /note="Description of Artificial Sequence: Synthetic oligonucleotide"
gccauuuucuugccugagg

SEQ ID NO: 1484 - RNA, 19 nt, Artificial Sequence
  source: /note="Description of Artificial Sequence: Synthetic oligonucleotide"
ccugaggcucaagaggccc

SEQ ID NO: 1485 - RNA, 19 nt, Artificial Sequence
  source: /note="Description of Artificial Sequence: Synthetic oligonucleotide"
aagaggcccagggagcaau

SEQ ID NO: 1486 - RNA, 19 nt, Artificial Sequence
  source: /note="Description of Artificial Sequence: Synthetic oligonucleotide"
ggagcaaugggagggggcu

SEQ ID NO: 1487 - RNA, 19 nt, Artificial Sequence
  source: /note="Description of Artificial Sequence: Synthetic oligonucleotide"
agggggcuccauggaggag

SEQ ID NO: 1488 - RNA, 19 nt, Artificial Sequence
  source: /note="Description of Artificial Sequence: Synthetic oligonucleotide"
ggaggaggugucccaagcu

SEQ ID NO: 1489 - RNA, 19 nt, Artificial Sequence
  source: /note="Description of Artificial Sequence: Synthetic oligonucleotide"
ucccaagcuuugaauaccc

SEQ ID NO: 1490 - RNA, 19 nt, Artificial Sequence
  source: /note="Description of Artificial Sequence: Synthetic oligonucleotide"
aauacccccagagaccuuu

SEQ ID NO: 1491 - RNA, 19 nt, Artificial Sequence
  source: /note="Description of Artificial Sequence: Synthetic oligonucleotide"
agagaccuuuucucuccca

SEQ ID NO: 1492 - RNA, 19 nt, Artificial Sequence
  source: /note="Description of Artificial Sequence: Synthetic oligonucleotide"
ucucccauaccaucacuga

SEQ ID NO: 1493 - RNA, 19 nt, Artificial Sequence
  source: /note="Description of Artificial Sequence: Synthetic oligonucleotide"
ucacugaguggcuugugau

SEQ ID NO: 1494 - RNA, 19 nt, Artificial Sequence
  source: /note="Description of Artificial Sequence: Synthetic oligonucleotide"
ggcuugugauucugggaug

SEQ ID NO: 1495 - RNA, 19 nt, Artificial Sequence
  source: /note="Description of Artificial Sequence: Synthetic oligonucleotide"
ugggauggacccucgcagc

SEQ ID NO: 1496 - RNA, 19 nt, Artificial Sequence
  source: /note="Description of Artificial Sequence: Synthetic oligonucleotide"
ucgcagcaggugcaagaga

SEQ ID NO: 1497 - RNA, 19 nt, Artificial Sequence
  source: /note="Description of Artificial Sequence: Synthetic oligonucleotide"
ugcaagagacagagccccc

SEQ ID NO: 1498 - RNA, 19 nt, Artificial Sequence
  source: /note="Description of Artificial Sequence: Synthetic oligonucleotide"
agagcccccaagccucugc

SEQ ID NO: 1499 - RNA, 19 nt, Artificial Sequence
  source: /note="Description of Artificial Sequence: Synthetic oligonucleotide"
cucugccccaaggggccca

SEQ ID NO: 1500 - RNA, 19 nt, Artificial Sequence
  source: /note="Description of Artificial Sequence: Synthetic oligonucleotide"
aaggggcccacaaagggga

SEQ ID NO: 1501 - RNA, 19 nt, Artificial Sequence
  source: /note="Description of Artificial Sequence: Synthetic oligonucleotide"
aaaggggagaagggccagc

SEQ ID NO: 1502 - RNA, 19 nt, Artificial Sequence
  source: /note="Description of Artificial Sequence: Synthetic oligonucleotide"
gggccagcccuacaucuuc

SEQ ID NO: 1503 - RNA, 19 nt, Artificial Sequence
  source: /note="Description of Artificial Sequence: Synthetic oligonucleotide"
aucuucagcucccauagcg

SEQ ID NO: 1504 - RNA, 19 nt, Artificial Sequence
  source: /note="Description of Artificial Sequence: Synthetic oligonucleotide"
ucccauagcgcuggcucag

SEQ ID NO: 1505 - RNA, 19 nt, Artificial Sequence
  source: /note="Description of Artificial Sequence: Synthetic oligonucleotide"
uggcucaggaagaaacccc

SEQ ID NO: 1506 - RNA, 19 nt, Artificial Sequence
  source: /note="Description of Artificial Sequence: Synthetic oligonucleotide"
aaccccaagcagcauucag

SEQ ID NO: 1507 - RNA, 19 nt, Artificial Sequence
  source: /note="Description of Artificial Sequence: Synthetic oligonucleotide"
cagcauucagcacacccca

SEQ ID NO: 1508 - RNA, 19 nt, Artificial Sequence
  source: /note="Description of Artificial Sequence: Synthetic oligonucleotide"
caccccaagggacaacccc

SEQ ID NO: 1509 - RNA, 19 nt, Artificial Sequence
  source: /note="Description of Artificial Sequence: Synthetic oligonucleotide"
acaaccccaucauaugaca

SEQ ID NO: 1510 - RNA, 19 nt, Artificial Sequence
  source: /note="Description of Artificial Sequence: Synthetic oligonucleotide"
acccucuccaugcccaacc

SEQ ID NO: 1511 - RNA, 19 nt, Artificial Sequence
  source: /note="Description of Artificial Sequence: Synthetic oligonucleotide"
ugcccaaccuaagauugug

SEQ ID NO: 1512 - RNA, 19 nt, Artificial Sequence
  source: /note="Description of Artificial Sequence: Synthetic oligonucleotide"
aagauuguguggguuuuuu

SEQ ID NO: 1513 - RNA, 19 nt, Artificial Sequence
  source: /note="Description of Artificial Sequence: Synthetic oligonucleotide"
uuuuuuaauuaaaaauguu

SEQ ID NO: 1514 - RNA, 19 nt, Artificial Sequence
  source: /note="Description of Artificial Sequence: Synthetic oligonucleotide"
uaaaaauguuaaaaguuuu

SEQ ID NO: 1515 - RNA, 19 nt, Artificial Sequence
  source: /note="Description of Artificial Sequence: Synthetic oligonucleotide"
aaaguuuuaaacaugaaaa

We claim:

1. A double stranded ribonucleic acid (RNAi) agent for inhibiting expression of a glucokinase (GCK) gene, wherein said double stranded RNAi agent comprises a sense strand and an antisense strand forming a double stranded region,
    wherein the antisense strand comprises at least 19 contiguous nucleotides differing by no more than 1 nucleotide from the nucleotide sequence of SEQ ID NO:140,
    wherein substantially all of the nucleotides of said sense strand and substantially all of the nucleotides of said antisense strand are modified nucleotides, and
    wherein said sense strand is conjugated to a ligand attached at the 3'-terminus.

2. The double stranded RNAi agent of claim 1, wherein no more than four of the nucleotides of the sense strand are unmodified nucleotides and/or no more than four of the nucleotides of the antisense strand are unmodified nucleotides.

3. The double stranded RNAi agent of claim 1, wherein at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative or a dodecanoic acid bisdecylamide group.

4. The double stranded RNAi agent of claim 1, further comprising at least one phosphorothioate internucleotide linkage.

5. The double stranded RNAi agent of claim 1, wherein each strand is no more than 30 nucleotides in length.

6. The double stranded RNAi agent of claim 1, wherein at least one strand comprises a 3' overhang of at least 1 nucleotide.

7. The double stranded RNAi agent of claim 1, wherein the ligand is an N-acetylgalactosamine (GalNAc) derivative.

8. The double stranded RNAi agent of claim 7, wherein the ligand is

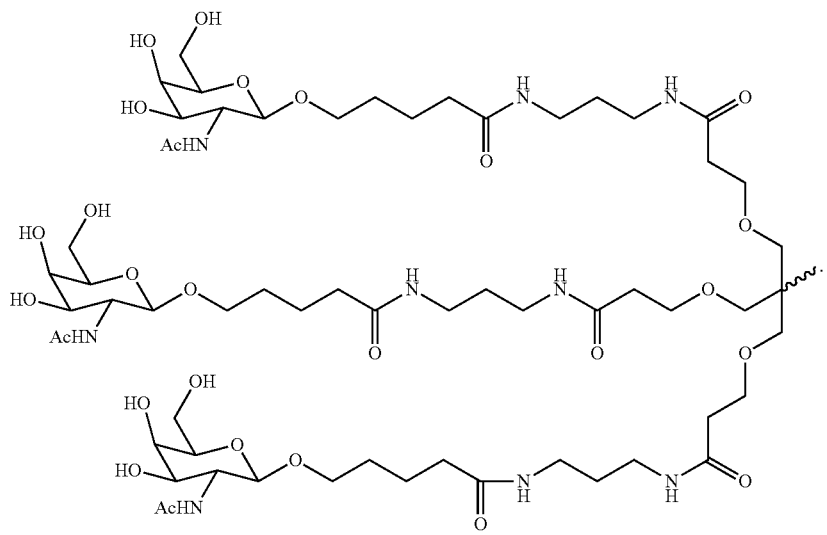 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

9. A cell containing the double stranded RNAi agent of claim 1.

10. A pharmaceutical composition for inhibiting expression of a glucokinase (GCK) gene comprising the double stranded RNAi agent of claim 1.

11. A method of inhibiting expression of a glucokinase (GCK) gene in a cell, the method comprising:

(a) contacting the cell with the double stranded RNAi agent of claim 1 or the pharmaceutical composition of claim 10; and (b) maintaining the cell produced in step (a) for a time sufficient to obtain degradation of the mRNA transcript of a GCK gene, thereby inhibiting expression of the GCK gene in the cell.

12. The method of claim 11, wherein said cell is within a subject.

13. The method of claim 12, wherein the subject is a human.

14. The method of claim 13, wherein the human subject suffers from a disease or disorder that would benefit from reduction in GCK expression.

15. The method of claim 14, wherein the disease or disorder is a glycogen storage disease (GSD).

16. A method of treating a subject having a disease or disorder that would benefit from reduction in expression of a glucokinase (GCK) gene, comprising administering to the subject a therapeutically effective amount of the double stranded RNAi agent of claim 1 or the pharmaceutical composition of claim 10, thereby treating said subject.

17. The method of claim 16, wherein the disease or disorder is a glycogen storage disease (GSD).

18. The method of claim 16, wherein the administration of the double stranded RNAi agent to the subject causes an increase in blood glucose levels, a decrease in plasma lactate levels, a decrease in plasma uric acid levels, a decrease in plasma triglyceride levels, a decrease in total plasma cholesterol levels, and/or a decrease in GCK protein accumulation.

19. The method of claim 16, further comprising administering a sodium-glucose co-transporter 2 (SGLT2) inhibitor to the subject.

20. A method of inhibiting the expression of a glucokinase (GCK) gene in a subject, the method comprising administering to said subject a therapeutically effective amount of the double stranded RNAi agent of claim 1 or the pharmaceutical composition of claim 10, thereby inhibiting the expression of GCK in said subject.

21. The double stranded RNAi agent of claim 1, wherein each of the sense strand and the antisense strand independently is 21 to 23 nucleotides in length.

22. The double stranded RNAi agent of claim 1, wherein the sense strand is 21 nucleotides in length and the antisense strand is 23 nucleotides in length.

23. The double stranded RNAi agent of claim 1, wherein the iRNA agent targets nucleotides 563-587 of SEQ ID NO:1.

24. The double stranded RNAi agent of claim 1, wherein the antisense strand comprises at least 20 contiguous nucleotides differing by no more than 3 nucleotides from the nucleotide sequence of 5'-UUGAUGCUUGUCCAGGAAGUCGG-3' (SEQ ID NO: 140).

25. The double stranded RNAi agent of claim 1, wherein the antisense strand comprises at least 15 contiguous nucleotides differing by no more than 3 nucleotides from the nucleotide sequence of 5'-AUCUGAUGCUUGUCCAGGAAGUC-3' (SEQ ID NO: 141).

26. The double stranded RNAi agent of claim 1, wherein the sense strand comprises the nucleotide sequence 5'-GACUUCCUGGACAAGCAUCAA-3' (SEQ ID NO: 51) and the antisense strand comprises the nucleotide sequence 5'-UUGAUGCUUGUCCAGGAAGUCGG-3' (SEQ ID NO: 140).

27. The double stranded RNAi agent of claim 1, wherein the sense strand comprises the nucleotide sequence of 5'-CUUCCUGGACAAGCAUCAGAU-3' (SEQ ID NO: 52) and the antisense strand comprises the nucleotide sequence 5'-AUCUGAUGCUUGUCCAGGAAGUC-3' (SEQ ID NO: 141).

28. The double stranded RNAi agent of claim 26, wherein the sense strand comprises the nucleotide sequence 5'-gsascuucCfuGfGfAfcaagcaucaa 3' (SEQ ID NO:229) and the antisense strand comprises the nucleotide sequence 5'-usUfsgauGfcUfUfguccAfgGfaagucsgsg 3' (SEQ IDNO:318), wherein a, g, c, and u are 2'-O-methyl (2'-OMe) modified A, G, C and U nucleotides, respectively; Af, Gf, Cf and Uf are 2' fluoro A, G, C and U modified nucleotides, respectively; and s is a phosphorothioate linkage.

29. The double stranded RNAi agent of claim 27, wherein the sense strand comprises the nucleotide sequence 5'-csusuccuGfgAfCfAfagcaucagau-3' (SEQ ID NO:230) and the antisense strand comprises the nucleotide sequence 5'-asUfscugAfuGfCfuuguCfcAfggaagsusc-3' (SEQ IDNO:319), wherein a, g, c, and u are 2'-O-methyl (2'-OMe) modified A, G, C and U nucleotides, respectively; Af, Gf, Cf and Uf are 2' fluoro A, G, C and U modified nucleotides, respectively; and s is a phosphorothioate linkage.

30. The double stranded RNAi agent of claim 28 or 29, further comprising a ligand.

31. The double stranded RNAi agent of claim 30, wherein the ligand is

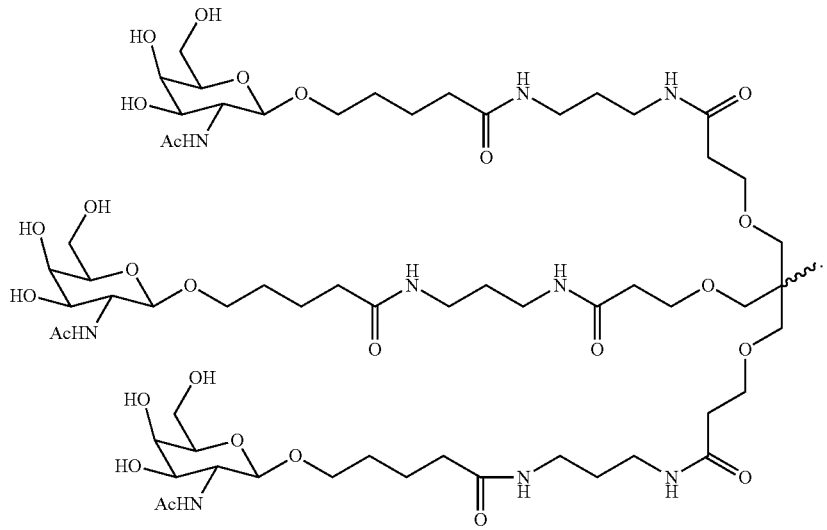 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

32. The double stranded RNAi agent of claim 8 or 31, wherein the double stranded RNAi agent is conjugated to the ligand as shown in the following schematic

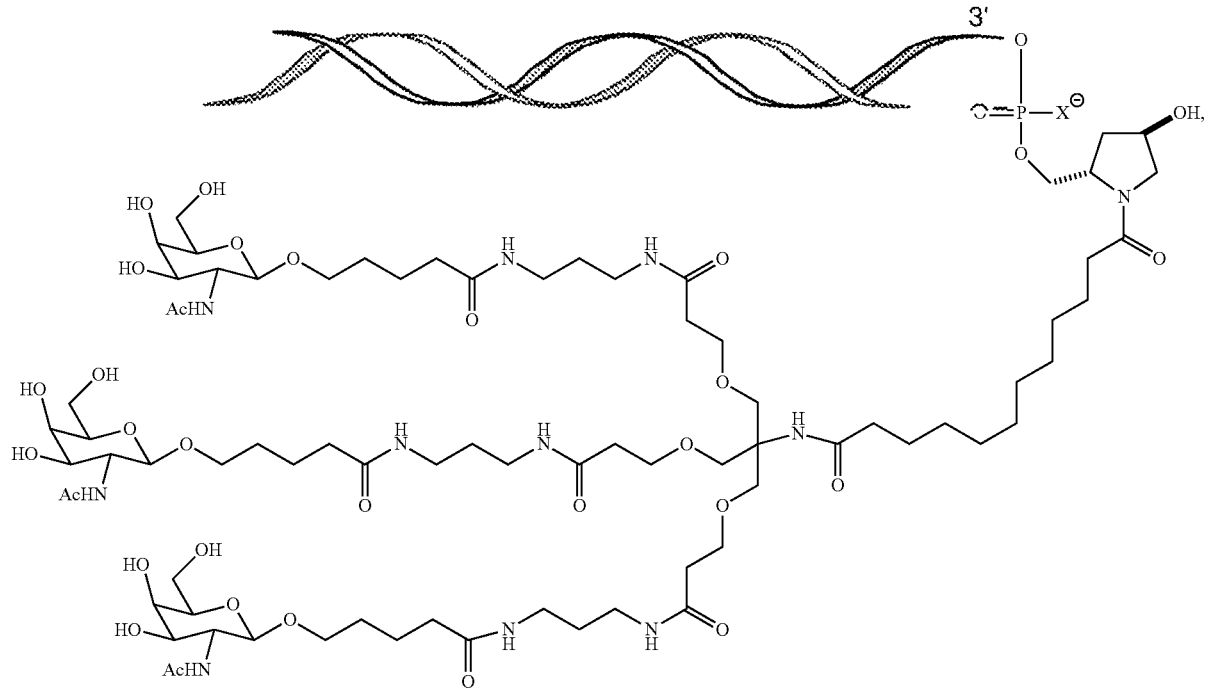

and, wherein X is O or S.

33. The double stranded RNAi agent of claim 32, wherein the X is O.

34. The double stranded RNAi agent of claim 2, wherein all of the nucleotides of the sense strand are modified nucleotides and/or all of the nucleotides of the antisense strand are modified nucleotides.

35. The double stranded RNAi agent of claim 1, wherein each strand is independently 19-30 nucleotides in length.

36. The double stranded RNAi agent of claim 1, wherein each strand is independently 19-25 nucleotides in length.

37. The double stranded RNAi agent of claim 1, wherein at least one strand comprises a 3' overhang of at least 2 nucleotides.

38. The double stranded RNAi agent of claim 1, wherein at least one of said modified nucleotides is selected from the group consisting of a 2'-O-methyl modified nucleotide and a 2'fluoro modified nucleotide.

* * * * *